(12) United States Patent
Edwards et al.

(10) Patent No.: US 6,822,072 B1
(45) Date of Patent: Nov. 23, 2004

(54) EXPRESSED SEQUENCE TAGS AND ENCODED HUMAN PROTEINS

(75) Inventors: Jean-Baptiste Dumas Milne Edwards, Paris (FR); Aymeric Duclert, Saint-Maur (FR); Jean-Yves Giordano, Paris (FR)

(73) Assignee: Genset S.A. (FR)

( * ) Notice: Subject to any disclaimer, the term of this patent is extended or adjusted under 35 U.S.C. 154(b) by 0 days.

(21) Appl. No.: 09/471,276

(22) Filed: Dec. 21, 1999

Related U.S. Application Data

(63) Continuation-in-part of application No. PCT/IB99/00712, filed on Apr. 9, 1999, which is a continuation-in-part of application No. 09/069,047, filed on Apr. 28, 1998, now abandoned, and a continuation-in-part of application No. 09/057,719, filed on Apr. 9, 1998, now abandoned.

(51) Int. Cl.$^7$ .................. C07K 14/00; A61K 38/00; C12Q 1/68; C07H 21/04
(52) U.S. Cl. .................. 530/300; 530/309; 530/350; 435/6; 435/320.1; 435/325; 536/23.1; 536/24.1
(58) Field of Search .................. 435/6, 320.1, 325, 435/252.3; 530/300, 309, 350; 536/23.1, 24.1

(56) References Cited

FOREIGN PATENT DOCUMENTS

| EP | 625 572 A1 | 11/1994 |
|----|------------|---------|
| WO | WO 96/34981 | 11/1996 |
| WO | WO 97/38003 | 10/1997 |
| WO | WO 98/07830 | 2/1998 |
| WO | WO-9845437 A2 * | 10/1998 |

OTHER PUBLICATIONS

Database sequence Geneseq acc.#AAV88297, Feb. 12, 1999. See sequence alignment.*
Watson et al., Recombinant DNA, second edition, Scientific American Books, 1994.*
Adams, et al., NATURE, "Initial Assessment of Human Gene Diversity and Expression Patterns Based Upon 83 Million Nucleotides of cDNA Sequence", vol. 377, Sep. 28, 1995.
Adams, et al., Nature Genetics, "Rapid cDNA Sequencing (expressed sequence tags) from a Directionally Cloned Human Infant Brain cDNA Library", vol. 4, pp. 373–380, Aug. 1993.
Caminci, et al., GENOMICS "High–Efficiency Full–Length cDNA Cloning by Biotinylated CAP Trapper", 37, 327–336, Article No. 0567, (1996).
Greenwood, et al., GENE, "Cloning of the Gene Encoding Human Somatostatin Receptor 2: Sequence Analysis of the 5'–Flanking Promoter Region", pp.291–292, 1995.
Hillier, et al., Genome Research, "Generation and Analysis of 280,000 Human Expressed Sequence Tags", 6: 807–828, 1996.
Kato, et al., GENE, "Construction of a Human Full–Length cDNA Bank", 243–250, Aug. 4, 1994.
Lockhart, et al., RESEARCH, "Expression Monitoring by Hybridization to High–Density Oligonucleotide Arrays", pp. 1675–1680, Oct. 7, 1996.
Von Heijne, Gunnar, Nucleic Acids Research, "A New Method for Predicting Signal Sequence Cleavage Sites", vol. 14, No. 11, 1986.
Tashiro, et al., SCIENCE, "Signal Sequence Trap: A Cloning Strategy for Secreted Proteins and Type I Membrane Proteins", vol. 261, Jul. 30, 1993.
Genbank Accession No. U52112, date May 9, 1996.
Genbank Accession No. P14314, date Jan. 1, 1990.
Genbank Accession No. J03075, date Feb. 1, 1990.
Genbank Accession No. AC0044085, date Feb. 3, 1998.
Genbank Accession No. AA306438, date Apr. 18, 1997.
Genbank Accession No. AA215334, date Feb. 5, 1997.
Genbank Accession No. AA352450, date Apr. 18, 1997.

* cited by examiner

*Primary Examiner*—John Brusca
*Assistant Examiner*—Shubo (Joe) Zhou
(74) *Attorney, Agent, or Firm*—Saliwanchik, Lloyd & Saliwanchik

(57) ABSTRACT

The sequences of 5' ESTs derived from mRNAs encoding secreted proteins are disclosed. The 5' ESTs may be to obtain cDNAs and genomic DNAs corresponding to the 5' ESTs. The 5' ESTs may also be used in diagnostic, forensic, gene therapy, and chromosome mapping procedures. Upstream regulatory sequences may also be obtained using the 5' ESTs. The 5' ESTs may also be used to design expression vectors and secretion vectors.

10 Claims, 5 Drawing Sheets

| Minimum signal peptide score | false positive rate | false negative rate | proba(0.1) | proba(0.2) |
|---|---|---|---|---|
| 3.5 | 0.121 | 0.036 | 0.467 | 0.664 |
| 4 | 0.096 | 0.06 | 0.519 | 0.708 |
| 4.5 | 0.078 | 0.079 | 0.565 | 0.745 |
| 5 | 0.062 | 0.098 | 0.615 | 0.782 |
| 5.5 | 0.05 | 0.127 | 0.659 | 0.813 |
| 6 | 0.04 | 0.163 | 0.694 | 0.836 |
| 6.5 | 0.033 | 0.202 | 0.725 | 0.855 |
| 7 | 0.025 | 0.248 | 0.763 | 0.878 |
| 7.5 | 0.021 | 0.304 | 0.78 | 0.889 |
| 8 | 0.015 | 0.368 | 0.816 | 0.909 |
| 8.5 | 0.012 | 0.418 | 0.836 | 0.92 |
| 9 | 0.009 | 0.512 | 0.856 | 0.93 |
| 9.5 | 0.007 | 0.581 | 0.863 | 0.934 |
| 10 | 0.006 | 0.679 | 0.835 | 0.919 |

Figure 2

| Step | Search characteristic | | | Selection Characteristics | | |
|---|---|---|---|---|---|---|
| | Program | Strand | Parameters | Identity (%) | Length (bp) | Comments |
| miscellanaeous | FASTA | both | - | 90 | 15 | |
| tRNA | FASTA | both | - | 80 | 60 | |
| rRNA | BLASTN | both | S=108 | 80 | 40 | |
| mtRNA | BLASTN | both | S=108 | 80 | 40 | |
| Procaryotic | BLASTN | both | S=144 | 90 | 40 | |
| Fungal | BLASTN | both | S=144 | 90 | 40 | |
| Alu | BLASTN | both | S=72, B=5 | 70 | 40 | max 5 matches, masking |
| L1 | BLASTN | both | S=72, B=5 | 70 | 40 | max 5 matches, masking |
| Repeats | BLASTN | both | S=72 | 70 | 40 | masking |
| PolyA | BLAST2N | top | W=6, S=10, E=1000, N=-12 | 90 | 10 | in the last 100 nucleotides |
| Polyadenylation signal | - | top | AATAAA allowing 1 mismatch | | | in the 50 nucleotides preceding the 5' end of the polA |
| Vertebrate | BLASTN then FASTA | both | - | 90 then 70 | 30 | first BLASTN and then FASTA on maching sequences |
| ESTs | BLAST2N | both | - | 90 | 30 | |
| Geneseq | BLASTN | both | W=8, B=10 | 90 | 30 | |
| ORF | BLASTP | top | W=8, B=10 | | - | on ORF proteins, max 10 matches |
| Proteins | BLASTX | top | E = 0.001 | 70 | 30 | |

Parameters used for each step of cDNA analysis

Figure 5

EXPRESSED SEQUENCE TAGS AND ENCODED HUMAN PROTEINS

RELATED APPLICATION

The present application is a continuation-in-part of PCT application PCT/IB99/00712 filed Apr., 9, 1999 which is a continuation-in-part of both U.S. patent application Ser. No. 09/057,719 filed Apr. 9, 1998 now abandoned and U.S. application Ser. No. 09/069,047 filed Apr. 28, 1998 now abandoned, all the disclosures of which are hereby incorporated herein by reference in their entirety, including any figures, tables or drawings.

BACKGROUND OF THE INVENTION

The estimated 50,000–100,000 genes scattered along the human chromosomes offer tremendous promise for the understanding, diagnosis; and treatment of human diseases. In addition, probes capable of specifically hybridizing to loci distributed throughout the human genome find applications in the construction of high resolution chromosome maps and in the identification of individuals.

In the past, the characterization of even a single human gene was a painstaking process, requiring years of effort. Recent developments in the areas of cloning vectors, DNA sequencing, and computer technology have merged to greatly accelerate the rate at which human genes can be isolated, sequenced, mapped, and characterized.

Currently, two different approaches are being pursued for identifying and characterizing the genes distributed along the human genome. In one approach, large fragments of genomic DNA are isolated, cloned, and sequenced. Potential open reading frames in these genomic sequences are identified using bioinformatics software. However, this approach entails sequencing large stretches of human DNA which do not encode proteins in order to find the protein encoding sequences scattered throughout the genome. In addition to requiring extensive sequencing, the bioinformatics software may mischaracterize the genomic sequences obtained, i.e., labeling non-coding DNA as coding DNA and vice versa.

An alternative approach takes a more direct route to identifying and characterizing human genes. In this approach, complementary DNAs (cDNAs) are synthesized from isolated messenger RNAs (mRNAs) which encode human proteins. Using this approach, sequencing is only performed on DNA which is derived from protein coding portions of the genome. Often, only short stretches of the cDNAs are sequenced to obtain sequences called expressed sequence tags (ESTs). The ESTs may then be used to isolate or purify extended cDNAs which include sequences adjacent to the EST sequences. The extended cDNAs may contain all of the sequence of the EST which was used to obtain them or only a portion of the sequence of the EST which was used to obtain them. In addition, the extended cDNAs may contain the full coding sequence of the gene from which the EST was derived or, alternatively, the extended cDNAs may include portions of the coding sequence of the gene from which the EST was derived. It will be appreciated that there may be several extended cDNAs which include the EST sequence as a result of alternate splicing or the activity of alternative promoters. Alternatively, ESTs having partially overlapping sequences may be identified and contigs comprising the consensus sequences of the overlapping ESTs may be identified.

In the past, these short EST sequences were often obtained from oligo-dT primed cDNA libraries. Accordingly, they mainly corresponded to the 3' untranslated region of the mRNA. In part, the prevalence of EST sequences derived from the 3' end of the mRNA is a result of the fact that typical techniques for obtaining cDNAs, are not well suited for isolating cDNA sequences derived from the 5' ends of mRNAs (Adams et al., *Nature* 377:3–174, 1996, Hillier et al., *Genome Res.* 6:807–828, 1996), the entire disclosures of which are incorporated herein by reference.

In addition, in those reported instances where longer cDNA sequences have been obtained, the reported sequences typically correspond to coding sequences and do not include the full 5' untranslated region (5'UTR) of the mRNA from which the cDNA is derived. Indeed, 5'UTRs have been shown to affect either the stability or translation of mRNAs. Thus, regulation of gene expression may be achieved through the use of alternative 5'UTRs as shown, for instance, for the translation of the tissue inhibitor of metalloprotease mRNA in mitogenically activated cells (Waterhouse et al, *J. Biol Chem.* 265:5585–9. 1990), the entire disclosure of which is incorporated herein by reference. Furthermore, modification of 5'UTR through mutation, insertion or translocation events may even be implied in pathogenesis. For instance, the fragile X syndrome, the most common cause of inherited mental retardation, is partly due to an insertion of multiple CGG trinucleotides in the 5'UTR of the fragile X mRNA resulting in the inhibition of protein synthesis via ribosome stalling (Feng et al, *Science* 268:7314, 1995), the entire disclosure of which is incorporated herein by reference. An aberrant mutation in regions of the 5'UTR known to inhibit translation of the proto-oncogene c-myc was shown to result in upregulation of c-myc protein levels in cells derived from patients with multiple myelomas (Willis et al, *Curr Top Microbiol Immunol* 224:269–76, 1997), the entire disclosure of which is incorporated herein by reference. In addition, the use of oligo-dT primed cDNA libraries does not allow the isolation of complete 5'UTRs since such incomplete sequences obtained by this process may not include the first exon of the mRNA, particularly in situations where the first exon is short. Furthermore, they may not include some exons, often short ones, which are located upstream of splicing sites. Thus, there is a need to obtain sequences derived from the 5' ends of mRNAs.

While many sequences derived from human chromosomes have practical applications, approaches based on the identification and characterization of those chromosomal sequences which encode a protein product are particularly relevant to diagnostic and therapeutic uses. In some instances, the sequences used in such therapeutic or diagnostic techniques may be sequences which encode proteins which are secreted from the cell in which they are synthesized. Those sequences encoding secreted proteins as well as the secreted proteins themselves, are particularly valuable as potential therapeutic agents. Such proteins are often involved in cell to cell communication and may be responsible for producing a clinically relevant response in their target cells. In fact, several secretory proteins, including tissue plasminogen activator, G-CSF, GM-CSF, erythropoietin, human growth hormone, insulin, interferon-α, interferon-β, interferon-γ, and interleukin-2, are currently in clinical use. These proteins are used to treat a wide range of conditions, including acute myocardial infarction, acute ischemic stroke, anemia, diabetes, growth hormone deficiency, hepatitis, kidney carcinoma, chemotherapy-induced neutropenia and multiple sclerosis. For these reasons, extended cDNAs encoding secreted proteins or portions thereof represent a valuable source of therapeutic agents. Thus, there is a need for the identification and characterization of secreted proteins and the nucleic acids encoding them.

In addition to being therapeutically useful themselves, secretory proteins include short peptides, called signal peptides, at their amino termini which direct their secretion. These signal peptides are encoded by the signal sequences located at the 5' ends of the coding sequences of genes encoding secreted proteins. These signal peptides can be used to direct the extracellular secretion of any protein to which they are operably linked. In addition, portions of the signal peptides called membrane-translocating sequences, may also be used to direct the intracellular import of a peptide or protein of interest. This may prove beneficial in gene therapy strategies in which it is desired to deliver a particular gene product to cells other than the cells in which it is produced. Signal sequences encoding signal peptides also find application in simplifying protein purification techniques. In such applications, the extracellular secretion of the desired protein greatly facilitates purification by reducing the number of undesired proteins from which the desired protein must be selected. Thus, there exists a need to identify and characterize the 5' portions of the genes for secretory proteins which encode signal peptides.

Sequences coding for non-secreted proteins may also find application as therapeutics or diagnostics. In particular, such sequences may be used to determine whether an individual is likely to express a detectable phenotype, such as a disease, as a consequence of a mutation in the coding sequence of a protein. In instances where the individual is at risk of suffering from a disease or other undesirable phenotype as a result of a mutation in such a coding sequence, the undesirable phenotype may be corrected by introducing a normal coding sequence using gene therapy. Alternatively, if the undesirable phenotype results from overexpression of the protein encoded by the coding sequence, expression of the protein may be reduced using antisense or triple helix based strategies.

The secreted or non-secreted human polypeptides encoded by the coding sequences may also be used as therapeutics by administering them directly to an individual having a condition, such as a disease, resulting from a mutation in the sequence encoding the polypeptide. In such an instance, the condition can be cured or ameliorated by administering the polypeptide to the individual.

In addition, the secreted or non-secreted human polypeptides or portions thereof may be used to generate antibodies useful in determining the tissue type or species of origin of a biological sample. The antibodies may also be used to determine the cellular localization of the secreted or non-secreted human polypeptides or the cellular localization of polypeptides which have been fused to the human polypeptides. In addition, the antibodies may also be used in immunoaffinity chromatography techniques to isolate, purify, or enrich the human polypeptide or a target polypeptide which has been fused to the human polypeptide.

Public information on the number of human genes for which the promoters and upstream regulatory regions have been identified and characterized is quite limited. In part, this may be due to the difficulty of isolating such regulatory sequences. Upstream regulatory sequences such as transcription factor binding sites are typically too short to be utilized as probes for isolating promoters from human genomic libraries. Recently, some approaches have been developed to isolate human promoters. One of them consists of making a CpG island library (Cross et al., Nature Genetics 6: 236244, 1994), the entire disclosure of which is incorporated herein by reference. The second consists of isolating human genomic DNA sequences containing SpeI binding sites by the use of SpeI binding protein. (Mortlock et al., Genome Res. 6:327–335, 1996), the entire disclosure of which is incorporated herein by reference. Both of these approaches have their limits due to a lack of specificity and of comprehensiveness. Thus, there exists a need to identify and systematically characterize the 5' portions of the genes.

The present 5' ESTs may be used to efficiently identify and isolate 5'UTRs and upstream regulatory regions which control the location, developmental stage, rate, and quantity of protein synthesis, as well as the stability of the mRNA. Once identified and characterized, these regulatory regions may be utilized in gene therapy or protein purification schemes to obtain the desired amount and locations of protein synthesis or to inhibit, reduce, or prevent the synthesis of undesirable gene products.

In addition, ESTs containing the 5' ends of protein genes may include sequences useful as probes for chromosome mapping and the identification of individuals. Thus, there is a need to identify and characterize the sequences upstream of the 5' coding sequences of genes.

SUMMARY OF THE INVENTION

The present invention relates to purified, isolated, or enriched 5' ESTs which include sequences derived from the authentic 5' ends of their corresponding mRNAs. The term "corresponding mRNA" refers to the mRNA which was the template for the cDNA synthesis which produced the 5' EST. These sequences will be referred to hereinafter as "5' ESTs." The present invention also includes purified, isolated or enriched nucleic acids comprising contigs assembled by determining a consensus sequences from a plurality of ESTs containing overlapping sequences. These contigs will be referred to herein as "consensus contigated 5'ESTs."

As used herein, the term "purified" does not require absolute purity; rather, it is intended as a relative definition. Individual 5' EST clones isolated from a cDNA library have been conventionally purified to electrophoretic homogeneity. The sequences obtained from these clones could not be obtained directly either from the library or from total human DNA. The cDNA clones are not naturally occurring as such, but rather are obtained via manipulation of a partially purified naturally occurring substance (messenger RNA). The conversion of mRNA into a cDNA library involves the creation of a synthetic substance (cDNA) and pure individual cDNA clones can be isolated from the synthetic library by clonal selection. Thus, creating a cDNA library from messenger RNA and subsequently isolating individual clones from that library results in an approximately $10^4$–$10^6$ fold purification of the native message. Purification of starting material or natural material to at least one order of magnitude, preferably two or three orders, and more preferably four or five orders of magnitude is expressly contemplated.

As used herein, the term "isolated" requires that the material be removed from its original environment (e.g., the natural environment if it is naturally occurring). For example, a naturally-occurring polynucleotide present in a living animal is not isolated, but the same polynucleotide, separated from some or all of the coexisting materials in the natural system, is isolated.

As used herein, the term "recombinant" means that the 5' EST is adjacent to "backbone" nucleic acid to which it is not adjacent in its natural environment. Additionally, to be "enriched" the 5' ESTs will represent 5% or more of the number of nucleic acid inserts in a population of nucleic acid backbone molecules. Backbone molecules according to the present invention include nucleic acids such as expression vectors, self-replicating nucleic acids, viruses, integrating nucleic acids, and other vectors or nucleic acids used to maintain or manipulate a nucleic acid insert of interest. Preferably, the enriched 5' ESTs represent 15% or more of the number of nucleic acid inserts in the population of recombinant backbone molecules. More preferably, the enriched 5' ESTs represent 50% or more of the number of nucleic acid inserts in the population of recombinant backbone molecules. In a highly preferred embodiment, the enriched 5' ESTs represent 90% or more of the number of nucleic acid inserts in the population of recombinant backbone molecules.

"Stringent," "moderate," and "low" hybridization conditions are as defined below.

The term "polypeptide" refers to a polymer of amino acids without regard to the length of the polymer, thus, peptides, oligopeptides, and proteins are included within the definition of polypeptide. This term also does not specify or exclude post-expression modifications of polypeptides, for example, polypeptides which include the covalent attachment of glycosyl groups, acetyl groups, phosphate groups, lipid groups and the like are expressly encompassed by the term polypeptide. Also included within the definition are polypeptides which contain one or more analogs of an amino acid (including, for example, non-naturally occurring amino acids, amino acids which only occur naturally in an unrelated biological system, modified amino acids from mammalian systems etc.), polypeptides with substituted linkages, as well as other modifications known in the art, both naturally occurring and non-naturally occurring.

As used interchangeably herein, the terms "nucleic acids," "oligonucleotides," and "polynucleotides" include RNA, DNA, or RNA/DNA hybrid sequences of more than one nucleotide in either single chain or duplex form. The term "nucleotide" as used herein as an adjective to describe molecules comprising RNA, DNA, or RNA/DNA hybrid sequences of any length in single-stranded or duplex form. The term "nucleotide" is also used herein as a noun to refer to individual nucleotides or varieties of nucleotides, meaning a molecule, or individual unit in a larger nucleic acid molecule, comprising a purine or pyrimidine, a ribose or deoxyribose sugar moiety, and a phosphate group, or phosphodiester linkage in the case of nucleotides within an oligonucleotide or polynucleotide. Although the term "nucleotide" is also used herein to encompass "modified nucleotides" which comprise at least one modifications (a) an alternative linking group, (b) an analogous form of purine, (c) an analogous form of pyrimidine, or (d) an analogous sugar, for examples of analogous linking groups, purine, pyrimidines, and sugars see for example PCT publication No. WO 95/04064. The polynucleotide sequences of the invention may be prepared by any known method, including synthetic, recombinant, ex vivo generation, or a combination thereof, as well as utilizing any purification methods known in the art.

The terms "base paired" and "Watson & Crick base paired" are used interchangeably herein to refer to nucleotides which can be hydrogen bonded to one another be virtue of their sequence identities in a manner like that found in double-helical DNA with thymine or uracil residues linked to adenine residues by two hydrogen bonds and cytosine and guanine residues linked by three hydrogen bonds (See Stryer, L., *Biochemistry*, 4$^{th}$ edition, 1995).

The terms "complementary" or "complement thereof" are used herein to refer to the sequences of polynucleotides which are capable of forming Watson & Crick base pairing with another specified polynucleotide throughout the entirety of the complementary region. For the purpose of the present invention, a first polynucleotide is deemed to be complementary to a second polynucleotide when each base in the first polynucleotide is paired with its complementary base. Complementary bases are, generally, A and T (or A and U), or C and G. "Complement" is used herein as a synonym from "complementary polynucleotide," "complementary nucleic acid" and "complementary nucleotide sequence" . These terms are applied to pairs of polynucleotides based solely upon their sequences and not any particular set of conditions under which the two polynucleotides would actually bind. Preferably, a "complementary" sequence is a sequence which an A at each position where there is a T on the opposite strand, a T at each position where there is an A on the opposite strand, a G at each position where there is a C on the opposite strand and a C at each position where there is a G on the opposite strand.

Thus, 5' ESTs in cDNA libraries in which one or more 5' ESTs make up 5% or more of the number of nucleic acid inserts in the backbone molecules are "enriched recombinant 5' ESTs" as defined herein. Likewise, 5' ESTs in a population of plasmids in which one or more 5' ESTs of the present invention have been inserted such that they represent 5% or more of the number of inserts in the plasmid backbone are "enriched recombinant 5' ESTs" as defined herein. However, 5' ESTs in cDNA libraries in which 5' ESTs constitute less than 5% of the number of nucleic acid inserts in the population of backbone molecules, such as libraries in which backbone molecules having a 5' EST insert are extremely rare, are not "enriched recombinant 5' ESTs."

The term "capable of hybridizing to the polyA tail of said mRNA" refers to and embraces all primers containing stretches of thymidine residues, so-called oligo(dT) primers, that hybridize to the 3' end of eukaryotic poly(A)+ mRNAs to prime the synthesis of a first cDNA strand. Techniques for generating said oligo(dT) primers and hybridizing them to mRNA to subsequently prime the reverse transcription of said hybridized mRNA to generate a first cDNA strand are well known to those skilled in the art and are described in *Current Protocols in Molecular Biology*, John Wiley and Sons, Inc. 1997 and Sambrook et al., *Molecular Cloning: A Laboratory Manual*, Second Edition, Cold Spring Harbor Laboratory Press, 1989, the entire disclosures of which are incorporated herein by reference. Preferably, said oligo(dT) primers are present in a large excess in order to allow the hybridization of all mRNA 3' ends to at least one oligo(dT) molecule. The priming and reverse transcription step are preferably performed between 37° C. and 55° C. depending on the type of reverse transcriptase used.

Preferred oligo(dT) primers for priming reverse transcription of mRNAs are oligonucleotides containing a stretch of thymidine residues of sufficient length to hybridize specifically to the polyA tail of mRNAs, preferably of 12 to 18 thymidine residues in length. More preferably, such oligo(T) primers comprise an additional sequence upstream of the poly(dT) stretch in order to allow the addition of a given sequence to the 5'end of all first cDNA strands which may then be used to facilitate subsequent manipulation of the cDNA. Preferably, this added sequence is 8 to 60 residues in length. For instance, the addition of a restriction site in 5' of cDNAs facilitates subcloning of the obtained cDNA. Alternatively, such an added 5' end may also be used to design primers of PCR to specifically amplify cDNA clones of interest.

In some embodiments, the present invention relates to 5' ESTs which are derived from genes encoding secreted proteins. As used herein, a "secreted" protein is one which, when expressed in a suitable host cell, is transported across or through a membrane, including transport as a result of signal peptides in its amino acid sequence. "Secreted" proteins include without limitation proteins secreted wholly (e.g. soluble proteins), or partially (e.g. receptors) from the cell in which they are expressed. "Secreted" proteins also include without limitation proteins which are transported across the membrane of the endoplasmic reticulum.

Such 5' ESTs include nucleic acid sequences, called signal sequences, which encode signal peptides which direct the extracellular secretion of the proteins encoded by the genes from which the 5' ESTs are derived. Generally, the signal peptides are located at the amino termini of secreted proteins.

Secreted proteins are translated by ribosomes associated with the "rough" endoplasmic reticulum. Generally, secreted proteins are co-translationally transferred to the membrane of the endoplasmic reticulum. Association of the ribosome with the endoplasmic reticulum during translation of secreted proteins is mediated by the signal peptide. The signal peptide is typically cleaved following its co-translational entry into the endoplasmic reticulum. After delivery to the endoplasmic reticulum, secreted proteins may proceed through the Golgi apparatus. In the Golgi apparatus, the proteins may undergo post-translational modification before entering secretory vesicles which transport them across the cell membrane.

The 5' ESTs of the present invention have several important applications. For example, they may be used to obtain and express cDNA clones which include the full protein coding sequences of the corresponding gene products, including the authentic translation start sites derived from the 5' ends of the coding sequences of the mRNAs from which the 5' ESTs are derived. These cDNAs will be referred to hereinafter as "full-length cDNAs." These cDNAs may comprise a 3' untranslated region and eventually a polyadenylation tail. These cDNAs may also include DNA derived from mRNA sequences upstream of the translation start site. The full-length cDNA sequences may be used to express the proteins corresponding to the 5' ESTs. As discussed above, secreted proteins and non-secreted proteins may be therapeutically important. Thus, the proteins expressed from the cDNAs may be useful in treating and controlling a variety of human conditions. The 5' ESTs may also be used to obtain the corresponding genomic DNA. The term "corresponding genomic DNA" refers to the genomic DNA which encodes the mRNA from which the 5' EST was derived.

Alternatively, the 5' ESTs may be used to obtain and express extended cDNAs encoding portions of the protein. In the case of secreted proteins, the portions may comprise the signal peptides of the secreted proteins or the mature proteins generated when the signal peptide is cleaved off.

The present invention includes isolated, purified, or enriched "EST-related nucleic acids." The terms "isolated," "purified" or "enriched" have the meanings provided above. As used herein, the term "EST-related nucleic acids" means the nucleic acids of SEQ ID NOs. 24–811 and 1600–1622, extended,cDNAs obtainable using the nucleic acids of SEQ ID NOs. 24–811 and 1600–1622, full-length cDNAs obtainable using the nucleic acids of SEQ ID NOs. 24–811 and 1600–1622 or genomic DNAs obtainable using the nucleic acids of SEQ ID NOs. 24–811 and 1600–1622. The present invention also includes the sequences complementary to the EST-related nucleic acids.

The present invention also includes isolated, purified, or enriched "fragments of EST-related nucleic acids." The terms "isolated," "purified" and "enriched" have the meanings described above. As used herein the term "fragments of EST-related nucleic acids" means fragments comprising at least 10, 12, 15, 18, 20, 23, 25, 28, 30, 35, 40, 50, 75, 100, 200, 300, 500, or 1000 consecutive nucleotides of the EST-related nucleic acids to the extent that fragments of these lengths are consistent with the lengths of the particular EST-related nucleic acids being referenced. In particular, fragments of EST-related nucleic acids refer to "polynucleotides described in Table II," "polynucleotides described in Table III," and "polynucleotides described in Table IV." The present invention also includes the sequences complementary to the fragments of the EST-related nucleic acids.

The present invention also includes isolated, purified, or enriched "positional segments of EST-related nucleic acids." As used herein, the term "positional segments of EST-related nucleic acids" includes segments comprising nucleotides 1–25, 26–50, 51–75, 76–100, 101–125, 126–150, 151–175, 176–200, 201–225, 226–250, 251–300, 301–325, 326–350, 351–375, 376–400, 401–425, 426–450, 451–475, 476–500, 501–525, 526–550, 551–575, 576–600 and 601-the terminal nucleotide of the EST-related nucleic acids to the extent that such nucleotide positions are consistent with the lengths of the particular EST-related nucleic acids being referenced. The term "positional segments of EST-related nucleic acids also includes segments comprising nucleotides 1–50, 51–100, 101–150, 151–200, 201–250, 251–300, 301–350, 351–400, 401–450, 450–500, 501–550, 551–600 or 601-the terminal nucleotide of the EST-related nucleic acids to the extent that such nucleotide positions are consistent with the lengths of the particular EST-related nucleic acids being referenced. The term "positional segments of EST-related nucleic acids" also includes segments comprising nucleotides 1–100, 101–200, 201–300, 301–400, 501–500, 500–600, or 601-the terminal nucleotide of the EST-related nucleic acids to the extent that such nucleotide positions are consistent with the lengths of the particular EST-related nucleic acids being referenced. In addition, the term "positional segments of EST-related nucleic acids" includes segments comprising nucleotides 1–200, 201–400, 400–600, or 601-the terminal nucleotide of the EST-related nucleic acids to the extent that such nucleotide positions are consistent with the lengths of the particular EST-related nucleic acids being referenced. The present invention also includes the sequences complementary to the positional segments of EST-related nucleic acids.

The present invention also includes isolated, purified, or enriched "fragments of positional segments of EST-related nucleic acids." As used herein, the term "fragments of positional segments of EST-related nucleic acids" refers to fragments comprising at least 10, 15, 18, 20, 23, 25, 28, 30, 35, 40, 50, 75, 100, 150, or 200 consecutive nucleotides of the positional segments of EST-related nucleic acids. The present invention also includes the sequences complementary to the fragments of positional segments of EST-related nucleic acids.

The present invention also includes isolated or purified "EST-related polypeptides." As used herein, the term "EST-related polypeptides" means the polypeptides encoded by the EST-related nucleic acids, including the polypeptides of SEQ D NOs. 812–1599.

The present invention also includes isolated or purified "fragments of EST-related polypeptides." As used herein, the term "fragments of EST-related polypeptides" means fragments comprising at least 5, 10, 15, 20, 25, 30, 35, 40, 50, 75, 100, or 150 consecutive amino acids of an EST-related polypeptide to the extent that fragments of these lengths are consistent with the lengths of the particular EST-related polypeptides being referenced. In particular, fragments of EST-related polypepides refer to polypeptides encoded by "polynucleotides described in Table II," "polynucleotides described in Table III," and "polynucleotides described in Table IV."

The present invention also includes isolated or purified "positional segments of EST-related polypeptides." As used herein, the term "positional segments of EST-related polypeptides" includes polypeptides comprising amino acid residues 1–25, 26–50, 51–75, 76–100, 101–125, 126–150, 151–175, 176–200, or 201-the C-terminal amino acid of the EST-related polypeptides to the extent that such amino acid residues are consistent with the lengths of the particular EST-related polypeptides being referenced. The term "positional segments of EST-related polypeptides also includes segments comprising amino acid residues 1–50, 51–100, 101–150, 151–200 or 201-the C-terminal amino acid of the EST-related polypeptides to the extent that such amino acid residues are consistent with the lengths of the particular EST-related polypeptides being referenced. The term "positional segments of EST-related polypeptides" also includes segments comprising amino acids 1–100 or 101–200 of the EST-related polypeptides to the extent that such amino acid residues are consistent with the lengths of particular EST-related polypeptides being referenced. In addition, the term "positional segments of EST-related polypeptides" includes segments comprising amino acid residues 1–200 or 201-the C-terminal amino acid of the EST-related polypeptides to the extent that amino acid residues are consistent with the lengths of the particular EST-related polypeptides being referenced.

The present invention also includes isolated or purified "fragments of positional segments of EST-related polypeptides." As used herein, the term "fragments of positional segments of EST-related polypeptides" means fragments comprising at least 5, 10, 15, 20, 25, 30, 35, 40, 50, 75, 100, or 150 consecutive amino acids of positional segments of EST-related polypeptides to the extent that fragments of these lengths are consistent with the lengths of the particular EST-related polypeptides being referenced.

The present invention also includes antibodies which specifically recognize the EST-related polypeptides, fragments of EST-related polypeptides, positional segments of EST-related polypeptides, or fragments of positional segments of EST-related polypeptides. In the case of secreted proteins, such as those of SEQ ID NOs. 1554–1580 antibodies which specifically recognize the mature protein generated when the signal peptide is cleaved may also be obtained as described below. Similarly, antibodies which specifically recognize the signal peptides of SEQ ID NOs. 812–1516 or 1554–1580 may also be obtained.

In some embodiments and in the case of secreted proteins, the EST-related nucleic acids, fragments of EST-related nucleic acids, positional segments of EST-related nucleic acids, or fragments of positional segments of nucleic acids include a signal sequence. In other embodiments, the EST-related nucleic acids, fragments of EST-related nucleic acids, positional segments of EST-related nucleic acids, or fragments of positional segments of nucleic acids may include the full coding sequence for the protein or, in the case of secreted proteins, the full coding sequence of the mature protein (i.e. the protein generated when the signal polypeptide is cleaved off). In addition, the EST-related nucleic acids, fragments of EST-related nucleic acids, positional segments of EST-related nucleic acids, or fragments of positional segments of nucleic acids may include regulatory regions upstream of the translation start site or downstream of the stop codon which control the amount, location, or developmental stage of gene expression.

As discussed above, both secreted and non-secreted human proteins may be therapeutically important. Thus, the proteins expressed from the EST-related nucleic acids, fragments of EST-related nucleic acids, positional segments of EST-related nucleic acids, or fragments of positional segments of nucleic acids may be useful in treating or controlling a variety of human conditions.

The EST-related nucleic acids, fragments of EST-related nucleic acids, positional segments of EST-related nucleic acids, or fragments of positional segments of nucleic acids may be used in forensic procedures to identify individuals or in diagnostic procedures to identify individuals having genetic diseases resulting from abnormal gene expression. In addition, the EST-related nucleic acids, fragments of EST-related nucleic acids, positional segments of EST-related nucleic acids, or fragments of positional segments of nucleic acids are useful for constructing a high resolution map of the human chromosomes.

The present invention also relates to secretion vectors capable of directing the secretion of a protein of interest. Such vectors may be used in gene therapy strategies in which it is desired to produce a gene product in one cell which is to be delivered to another location in the body. Secretion vectors may also facilitate the purification of desired proteins.

The present invention also relates to expression vectors capable of directing the expression of an inserted gene in a desired spatial or temporal manner or at a desired level. Such vectors may include sequences upstream of the EST-related nucleic acids, fragments of EST-related nucleic acids, positional segments of EST-related nucleic acids, or fragments of positional segments of nucleic acids, such as promoters or upstream regulatory sequences.

The present invention also comprises fusion vectors for making chimeric polypeptides comprising a first polypeptide and a second polypeptide. Such vectors are useful for determining the cellular localization of the chimeric polypeptides or for isolating, purifying or enriching the chimeric polypeptides.

The EST-related nucleic acids, fragments of EST-related nucleic acids, positional segments of EST-related nucleic acids, or fragments of positional segments of nucleic acids may also be used for gene therapy to control or treat genetic diseases. In the case of secreted proteins, signal peptides may be fused to heterologous proteins to direct their extracellular secretion.

Bacterial clones containing Bluescript plasmids having inserts containing the sequence of the non-aligned 5' ESTs, also referred to as singletons, and sequences of the 5' ESTs which were aligned to yield consensus contigated 5' ESTs are presently stored at 80° C. in 4% (v/v) glycerol in the inventor's laboratories under internal designations. The non-aligned 5' ESTs are those which comprise a single EST from a single tissue in the listing of Table V. The inserts may be recovered from the stored materials by growing the appropriate clones on a suitable medium. The Bluescript DNA can then be isolated using plasmid isolation procedures familiar to those skilled in the art such as alkaline lysis minipreps or large scale alkaline lysis plasmid isolation procedures. If desired the plasmid DNA may be further enriched by centrifugation on a cesium chloride gradient, size exclusion chromatography, or anion exchange chromatography. The plasmid DNA obtained using these procedures may then be manipulated using standard cloning techniques familiar to those skilled in the art. Alternatively, a PCR can be performed with primers designed at both ends of the inserted EST-related nucleic acids, fragments of EST-related nucleic acids, positional segments of EST-related nucleic acids, or fragments of positional segments of nucleic acids. The PCR product which corresponds to the EST-related nucleic acids, fragments of EST-related nucleic acids, positional segments of EST-related nucleic acids, or fragments of positional segments of nucleic acids can then be manipulated using standard cloning techniques familiar to those skilled in the art.

One embodiment of the present invention is a purified nucleic acid comprising, consisting essentially of, or consisting of a sequence selected from the group consisting of SEQ. ID NOs. 24–811 and SEQ ID NOs. 1600–1622 and sequences complementary to the sequences of SEQ ID NOs. 24–811 and SEQ ID NOs. 1600–1622.

Another embodiment of the present invention is a purified nucleic acid comprising, consisting essentially of, or consisting of at least 10, 12, 15, 18, 20, 23, 25, 28, 30, 35, 40, 50, 75, 100, 200, 300, 500, or 1000 consecutive nucleotides, to the extent that fragments of these lengths are consistent with the specific sequence, of a sequence selected from the group consisting of SEQ ID NOs. 24–811 and SEQ ID NOs. 1600–1622 and sequences complementary to the sequences of SEQ ID NOs. 24–811 and SEQ ID NOs. 1600–1622.

A further embodiment of the present invention is a purified nucleic acid comprising, consisting essentially of, or consisting of the coding sequence of a sequence selected from the group consisting of SEQ ID NOs. 24–811.

Yet another embodiment of the present invention is a purified nucleic acid comprising, consisting essentially of, or consisting of the full coding sequences of a sequence selected from the group consisting of SEQ ID NOs. 766–792 wherein the full coding sequence comprises the sequence encoding the signal peptide and the sequence encoding the mature protein.

Still another embodiment of the present invention is a purified nucleic acid comprising, consisting essentially of, or consisting of a contiguous span of a sequence selected from the group consisting of SEQ ID NOs. 766–792 which encodes the mature protein.

Another embodiment of the present invention is a purified nucleic acid comprising, consisting essentially of, or consisting of a contiguous span of a sequence selected from the group consisting of SEQ ID NOs. 24–728 and 766–792 which encodes the signal peptide.

Another embodiment of the present invention is a purified nucleic acid encoding a polypeptide comprising, consisting essentially of, or consisting of a sequence selected from the group consisting of the sequences of SEQ ID NOs. 812–1599.

Another embodiment of the present invention is a purified nucleic acid encoding a polypeptide comprising, consisting essentially of, or consisting of a sequence selected from the group consisting of the sequences of SEQ ID NOs. 1554–1580.

Another embodiment of the present invention is a purified nucleic acid encoding a polypeptide comprising, consisting essentially of, or consisting of a mature protein included in a sequence selected from the group consisting of the sequences of SEQ ID NOs. 1554–1580.

Another embodiment of the present invention is a purified nucleic acid encoding a polypeptide comprising, consisting essentially of, or consisting of a signal peptide included in a sequence selected from the group consisting of the sequences of SEQ ID NOs. 812–1516 and 1554–1580.

Another embodiment of the present invention is a purified nucleic acid encoding a polypeptide, wherein said nucleic acid comprises, consists essentially of, or consists of a) a sequence selected from the group consisting of SEQ ID NOs. 24–811 and SEQ ID NOs. 1600–1622; and b) a polyadenylation tail.

Another embodiment of the present invention is a purified nucleic acid encoding a polypeptide wherein said nucleic acid comprises, consists essentially of, or consists of a) a sequence encoding a polypeptide selected from the group consisting of SEQ ID NOs. 812–1599; and b) a polyadenylation tail.

Another embodiment of the present invention is a purified nucleic acid at least 20, 25, 30, 35, 40, 50, 75, 100, 200, 300, 500 or 1000 nucleotides in length which hybridizes under stringent conditions to a sequence selected from the group consisting of SEQ ID NOs. 24–811 and SEQ ID NOs. 1600–1622 and sequences complementary to the sequences of SEQ ID NOs. 24–811 and SEQ ID NOs. 1600–1622.

Another embodiment of the present invention is a purified or isolated polypeptide comprising, consisting essentially of, or consisting of a sequence selected from the group consisting of the sequences of SEQ ID NOs. 812–1599.

Another embodiment of the present invention is a purified or isolated polypeptide comprising, consisting essentially of, or consisting of a sequence selected from the group consisting of SEQ ID NOs. 1554–1580.

Another embodiment of the present invention is a purified or isolated polypeptide comprising, consisting essentially of, or consisting of a mature protein of a polypeptide selected from the group consisting of SEQ ID NOs. 15541580.

Another embodiment of the present invention is a purified or isolated polypeptide comprising, consisting essentially of, or consisting of a signal peptide of a sequence selected from the group consisting of the polypeptides of SEQ ID NOs. 812–1516 and 1554–1580.

Another embodiment of the present invention is a purified or isolated polypeptide comprising, consisting essentially of, or consisting of at least 12, 15, 18, 20, 23, 25, 28, 30, 35, 40, 50, 75, 100, 200, 300, 500, or 1000 consecutive amino acids, to the extent that fragments of these lengths are consistent with the specific sequence, of a sequence selected from the group consisting of the sequences of SEQ ID NOs. 812–1599.

Another embodiment of the present invention is a method of making a cDNA comprising the steps of contacting a collection of mRNA molecules from human cells with a primer. comprising at least 12, 15, 18, 20, 23, 25, 28, 30, 35, 40, or 50 consecutive nucleotides of a sequence selected from the group consisting of the sequences complementary to SEQ ID NOs. 24–811 and SEQ ID NOs. 1600–1622, hybridizing said primer to an mRNA in said collection that encodes said protein reverse transcribing said hybridized primer to make a first cDNA strand from said mRNA, making a second cDNA strand complementary to said first cDNA strand and isolating the resulting cDNA encoding said protein comprising said first cDNA strand and said second cDNA strand.

Another embodiment of the present invention is a purified cDNA obtainable by the method of the preceding paragraph. In one aspect of this embodiment, the cDNA encodes at least a portion of a human polypeptide. Preferably, said human polypeptide comprises at least 8, 10, 12, 15, 18, 20, 23, 25, 28, 30, 35, 40, 50, 75, 100, 200, 300, 500, or 1000 consecutive amino acids, to the extent that fragments of these lengths are consistent with the specific sequence, of a sequence encoded by a sequence selected from the group consisting of the sequences of SEQ ID NOs. 24–811. More preferably, said human polypeptide comprises the polypeptide encoded by a sequence selected from the group consisting of the sequences of SEQ ID NOs. 24–811. In one aspect of this embodiment, said cDNA comprises the complete coding sequence of said human polypeptide.

Another embodiment of the present invention is a method of making a cDNA comprising the steps of contacting a cDNA collection with a detectable probe comprising at least 12, 15, 18, 20, 23, 25, 28, 30, 35, 40, or 50 consecutive nucleotides of a sequence selected from the group consisting of SEQ ID NOs. 24–811 and SEQ ID NOs. 1600–1622 and the sequences complementary to SEQ ID NOs. 24–811 and SEQ ID NOs. 1600–1622 under conditions which permit said probe to hybridize to a cDNA, identifying said cDNA which hybridizes to said detectable probe, and isolating said cDNA.

Another embodiment of the present invention is a purified cDNA obtainable by the method of the preceding paragraph.

In one aspect of this embodiment, the cDNA encodes at least a portion of a human polypeptide. Preferably, said human polypeptide comprises at least 8, 10, 12, 15, 18, 20, 23, 25, 28, 30, 35, 40, 50, 75, 100, 200, 300, 500, or 1000 consecutive amino acids, to the extent that fragments of these lengths are consistent with the specific sequence, of a sequence encoded by a sequence selected from the group consisting of the sequences of SEQ ID NOs. 24–811. More preferably, said human polypeptide comprises the polypeptide encoded by a sequence selected from the group consisting of the sequences of SEQ ID NOs. 24–811. In one aspect of this embodiment, said cDNA comprises the complete coding sequence of said human polypeptide.

Another embodiment of the present invention is a method of making a cDNA comprising the steps of contacting a collection of mRNA molecules from human cells with a first primer capable of hybridizing to the polyA tail of said mRNA, hybridizing said first primer to said polyA tail, reverse transcribing said mRNA to make a first cDNA strand, making a second cDNA strand complementary to said first cDNA strand using at least one primer comprising at least 12, 15, 18, 20, 23, 25, 28, 30, 35, 40, or 50 consecutive nucleotides of a sequence selected from the group consisting of SEQ ID NOs. 24–811 and SEQ ID NOs. 1600–1622, and isolating the resulting cDNA comprising said first cDNA strand and said second cDNA strand.

Another embodiment of the present invention is a purified cDNA obtainable by the method of the preceding paragraph.

In one aspect of this embodiment, said cDNA encodes at least a portion of a human polypeptide. Preferably, said human polypeptide comprises at least 8, 10, 12, 15, 18, 20, 23, 25, 28, 30, 35, 40, 50, 75, 100, 200, 300, 500, or 1000 consecutive amino acids, to the extent that fragments of these lengths are consistent with the specific sequence, of a sequence encoded by a sequence selected from the group consisting of the sequences of SEQ ID NOs. 24–811. More preferably, said human polypeptide comprises the polypeptide encoded by a sequence selected from the group consisting of the sequences of SEQ ID NOs. 24–811. In one aspect of this embodiment, said cDNA comprises the complete coding sequence of said human polypeptide.

In another aspect of the preceding method the second cDNA strand is made by contacting said first cDNA strand with a second primer comprising at least 12, 15, 18, 20, 23, 25, 28, 30, 35, 40, or 50 consecutive nucleotides of a sequence selected from the group consisting of SEQ ID NOs. 24–811 and SEQ ID NOs. 1600–1622 and a third primer which sequence is fully included within the sequence of said first primer, performing a first polymerase chain reaction with said second and third primers to generate a first PCR product, contacting said first PCR product with a fourth primer, said fourth primer comprising at least 12, 15, 18, 20, 23, 25, 28, 30, 35, 40, or 50 consecutive nucleotides of said sequence selected from the group consisting of SEQ ID NOs. 24–811 and SEQ ID NOs. 1600–1622, and a fifth primer which sequence is fully included within the sequence of said third primer, wherein said fourth and fifth primers hybridize to sequences within said first PCR product, and performing a second polymerase chain reaction, thereby generating a second PCR product.

One aspect of this embodiment is a purified cDNA obtainable by the method of the preceding paragraph.

In another aspect of this embodiment, said cDNA encodes at least a portion of a human polypeptide. Preferably, said human polypeptide comprises at least 8, 10, 12, 15, 18, 20, 23, 25, 28, 30, 35, 40, 50, 75, 100, 200, 300, 500, or 1000 consecutive amino acids, to the extent that fragments of these lengths are consistent with the specific sequence, of a sequence encoded by a sequence selected from the group consisting of the sequences of SEQ ID NOs. 24–811. More preferably, said human polypeptide comprises the polypeptide encoded by a sequence selected from the group consisting of the sequences of SEQ ID NOs. 24–811. In one aspect of this embodiment, said cDNA comprises the complete coding sequence of said human polypeptide.

Alternatively, the second cDNA strand may be made by contacting said first cDNA strand with a second primer comprising at least 12, 15, 18, 20, 23, 25, 28, 30, 35, 40, or 50 consecutive nucleotides of a sequence selected from the group consisting of SEQ ID NOs. 24–811 and SEQ ID NOs. 1600–1622, hybridizing said second primer to said first strand cDNA, and extending said hybridized second primer to generate said second cDNA strand.

One aspect of the above embodiment is a purified cDNA obtainable by the method of the preceding paragraph.

In a further aspect of this embodiment said cDNA encodes at least a portion of a human polypeptide. Preferably, said human polypeptide comprises at least 8, 10, 12, 15, 18, 20, 23, 25, 28, 30, 35, 40, 50, 75, 100, 200, 300, 500, or 1000 consecutive amino acids, to the extent that fragments of these lengths are consistent with the specific sequence, of a sequence encoded by a sequence selected from the group consisting of the sequences of SEQ ID NOs. 24–811. More preferably, said human polypeptide comprises the polypeptide encoded by a sequence selected from the group consisting of the sequences of SEQ ID NOs. 24–811. In one aspect of this embodiment, said cDNA comprises the complete coding sequence of said human polypeptide.

Another embodiment of the present invention is a method of making a polypeptide comprising the steps of obtaining a cDNA which encodes a polypeptide encoded by a nucleic acid comprising, consisting essentially of, or consisting of a sequence selected from the group consisting of SEQ ID NOs. 24–811 or a cDNA which encodes a polypeptide comprising at least 6, 8, 10, 12, 15, 18, 20, 23, 25, 28, 30, 35, 40, or 50 consecutive amino acids of a polypeptide encoded by a sequence selected from the group consisting of SEQ ID NOs. 24–811, inserting said cDNA in an expression vector such that said cDNA is operably linked to a promoter, introducing said expression vector into a host cell whereby said host cell produces the protein encoded by said cDNA, and isolating said protein.

Another aspect of this embodiment is an isolated protein obtainable by the method of the preceding paragraph.

Another embodiment of the present invention is a method of obtaining a promoter DNA comprising the steps of obtaining genomic DNA located upstream of a nucleic acid comprising a sequence selected from the group consisting of SEQ ID NOs. 24–811 and SEQ ID NOs. 1600–1622 and the sequences complementary to the sequences of SEQ ID NOs. 24–811 and SEQ ID NOs. 1600–1622, screening said genomic DNA to identify a promoter capable of directing transcription initiation, and isolating said DNA comprising said identified promoter.

In one aspect of this embodiment, said obtaining step comprises walking from genomic DNA comprising a sequence selected from the group consisting of SEQ ID NOs. 24–811 and SEQ ID NOs. 1600–1622 and the sequences complementary to SEQ ID NOs. 24–811 and SEQ ID NOs. 1600–1622. In another aspect of this embodiment, said screening step comprises inserting genomic DNA located upstream of a sequence selected from the group consisting of SEQ ID NOs. 24–811 and SEQ ID NOs. 1600–1622 and the sequences complementary to SEQ ID NOs. 24–811 and SEQ ID NOs. 1600–1622 into a promoter reporter vector. For example, said screening step may comprise identifying motifs in genomic DNA located upstream of a sequence selected from the group consisting of SEQ ID NOs. 24–811 and SEQ ID NOs. 1600–1622 and the sequences complementary to SEQ ID NOs. 24–811 and SEQ ID NOs. 1600–1622 which are transcription factor binding sites or transcription start sites.

Another embodiment of the present invention is a isolated promoter obtainable by the method of the paragraph above.

Another embodiment of the present invention is an array of discrete ESTs or fragments thereof of at least 12, 15, 18, 20, 23, 25, 28, 30, 35, 40, 50, or 100 nucleotides in length, said array comprising at least one sequence selected from the group consisting of SEQ ID NOs. 24–811 and SEQ ID NOs. 1600–1622, the sequences complementary to the sequences of SEQ ID NOs. 24–811 and SEQ ID NOs. 1600–1622 and fragments comprising at least 12, 15, 18,20, 23, 25, 28,30, 35, 40, 50, or 100 consecutive nucleotides of a sequence selected from the group consisting of SEQ ID NOs. 24–811 and SEQ ID NOs. 1600–1622 and the sequences complementary to SEQ ID NOs. 24–811 and SEQ ID NOs. 1600–1622. In some aspects of this embodiment, the array includes at least two sequences selected from the group consisting of SEQ ID NOs. 24–811 and SEQ ID NOs. 1600–1622, the sequences complementary to the sequences of SEQ ID NOs. 24–811 and SEQ ID NOs. 1600–1622, and fragments comprising at least 12, 15, 18, 20, 23, 25, 28, 30, 35, 40, 50, or 100 consecutive nucleotides of a sequence selected from the group consisting of SEQ ID NOs. 24–811 and SEQ ID NOs. 1600–1622 and the sequences complementary to SEQ ID NOs. 24–811 and SEQ ID NOs. 1600–1622. In another aspect of this embodiment., the array includes at least one, three, five, ten, fifteen, or twenty sequences selected from the group consisting of SEQ ID NOs. 24–811 and SEQ ID NOs. 1600–1622, the sequences complementary to the sequences of SEQ ID NOs. 24–811 and SEQ ID NOs. 1600–1622 and fragments comprising at least 12, 15, 18, 20, 23, 25, 28, 30, 35, 40, 50, or 100 consecutive nucleotides of a sequence selected from the group consisting of SEQ ID NOs. 24–811 and SEQ ID NOs. 1600–1622 and the sequences complementary to SEQ ID NOs. 24–811 and SEQ ID NOs. 1600–1622.

Another embodiment of the present invention is an enriched population of recombinant nucleic acids, said recombinant nucleic acids comprising an insert nucleic acid and a backbone nucleic acid, wherein at least 0.01%, 0.05%, 0.1%, 0.5%, 1%, 2%, 5%, 10%, or 20% of said insert nucleic acids in said population comprise a sequence selected from the group consisting of SEQ ID NOs. 24–811 and SEQ ID NOs. 1600–1622, the sequences complementary to SEQ ID NOs. 24–811 and SEQ ID NOs. 1600–1622, and fragments comprising at least 12, 15, 18, 20, 23, 25, 28, 30, 35, 40, 50, or 100 consecutive nucleotides of a sequence selected from the group consisting of SEQ ID NOs. 24–811 and SEQ ID NOs. 1600–1622 and the sequences complementary to SEQ ID NOs. 24–811 and SEQ ID NOs. 1600–1622.

Another embodiment of the present invention is a purified or isolated antibody capable of specifically binding to a polypeptide comprising a sequence selected from the group consisting of SEQ ID NOs. 812–1599.

Another embodiment of the present invention is a purified or isolated antibody capable of specifically binding to a polypeptide comprising at least 6, 8, 10, 12, 15, 18, 20, 23, 25, 28, 30, 35, 40, or 50 consecutive amino acids of a sequence selected from the group consisting of SEQ ID NOs. 812–1599.

Yet, another embodiment of the present invention is an antibody composition capable of selectively binding to an epitope-containing fragment of a polypeptide comprising a contiguous span of at least 8, 10, 12, 15, 18, 20, 23, 25, 28, 30, 35, 40, or 50 amino acids of any of SEQ ID NOs. 812–1599, wherein said antibody is polyclonal or monoclonal.

Another embodiment of the present invention is a computer readable medium having stored thereon a sequence selected from the group consisting of a nucleic acid code of SEQ ID NOs. 24–811 and 1600–1622 and a polypeptide code of SEQ ID NOs. 812–1599.

Another embodiment of the present invention is a computer system comprising a processor and a data storage device wherein said data storage device has stored thereon a sequence selected from the group consisting of a nucleic acid code of SEQ ID NOs. 24–811 and 1600–1622 and a polypeptide code of SEQ ID NOs. 812–1599. In one aspect of this embodiment the computer system further comprises a sequence comparer and a data storage device having reference sequences stored thereon. For example, the sequence comparer may comprise a computer program which indicates polymorphisms. In another aspect of this embodiment, the computer system further comprises an identifier which identifies features in said sequence.

Another embodiment of the present invention is a method for comparing a first sequence to a reference sequence wherein said first sequence is selected from the group consisting of a nucleic acid code of SEQID NOs. 24–811 and 1600–1622 and a polypeptide code of SEQ ID NOs. 812–1599 comprising the steps of reading said first sequence and said reference sequence through use of a computer program which compares sequences and determining differences between said first sequence and said reference sequence with said computer program. In some aspects of this embodiment, said step of determining differences between the first sequence and the reference sequence comprises identifying polymorphisms.

Another embodiment of the present invention is a method for identifying a feature in a sequence selected from the group consisting of a nucleic acid code of SEQ ID NOs. 24–811 and 1600–1622 and a polypeptide code of SEQ ID NOs. 812–1599 comprising the steps of reading said sequence through the use of a computer program which identifies features in sequences and identifying features in said sequence with said computer program.

Another embodiment of the present invention is a vector comprising a nucleic acid according to any one of the nucleic acids described above.

In one aspect of this embodiment, the vector encodes a fusion protein comprising a signal peptide encoded by a sequence selected from the group consisting of the sequences of SEQ ID NOs. 24–811 and 1600–1622 operably linked to a second nucleic acid encoding an heterologous polypeptide.

Another embodiment of the present invention is a host cell containing any of the above vectors.

Another embodiment of the present invention is a method for directing the secretion of a polypeptide comprising the steps of culturing a host cell containing a vector encoding a fusion protein, said fusion protein comprises a signal peptide encoded by a sequence selected from the group consisting of the sequences of SEQ ID NOs. 24–811 and 1600–1622 operably linked to a second nucleic acid encoding an heterologous polypeptide, under conditions which allow the secretion of said fusion protein and recovering said fusion protein. In one aspect of this embodiment, said fusion protein is secreted into the extracellular environment. In another aspect of this embodiment, said fusion protein is inserted into the membrane of said host cell Another embodiment of the present invention is a method for importing a polypeptide into a cell comprising the step of contacting said cell with a fusion protein comprising a signal peptide encoded by a sequence selected from the group consisting of the sequences of SEQ ID NOs: 38–270, operably linked to said polypeptide.

Another embodiment of the present invention is a method of making any of the nucleic acids described above comprising the steps of introducing said nucleic acid into a host cell such that said nucleic acid is present in multiple copies in each host cell and isolating said nucleic acid from said host cell.

Another embodiment of the present invention is a method of making a nucleic acid of any of the nucleic acids described above comprising the step of sequentially linking together the nucleotides in said nucleic acids.

Another embodiment of the present invention is a method of making any of the polypeptides described above wherein said polypeptides is 150 amino acids in length or less comprising the step of sequentially linking together the amino acids in said polypeptide.

Another embodiment of the present invention is a method of making any of the polypeptides described above wherein said polypeptides is 120 amino acids in length or less comprising the step of sequentially linking together the amino acids in said polypeptides.

BRIEF DESCRIPTION OF THE DRAWINGS

FIG. 2 is an analysis of the 43 amino terminal amino acids of all human SwissProt proteins to determine the frequency of false positives and false negatives using the techniques for signal peptide identification described herein.

FIG. 5 is a table with all of the parameters that can be used for each step of extended cDNA analysis.

DETAILED DESCRIPTION OF THE PREFERRED EMBODIMENTS

I. Obtaining 5'ESTs from cDNA Libraries Including the 5' Ends of Their Corresponding mRNAs The 5' ESTs of the present invention were obtained from cDNA libraries including cDNAs which include the 5' end of their corresponding mRNAs. The general method used to obtain such cDNA libraries is described in Examples 1 to 5.

EXAMPLE 1

Preparation of mRNA

Total human RNAs or polyA$^+$ RNAs derived from 29 different tissues were respectively purchased from LABIMO and CLONTECH and used to generate 44 cDNA libraries as described below. The purchased RNA had been isolated from cells or tissues using acid guanidium thiocyanate-phenol-chloroform extraction (Chomczyniski and Sacchi, *Analytical Biochemistry* 162:156–159, 1987), the entire disclosure of which is incorporated herein by reference. PolyA$^+$ RNA was isolated from total RNA (LABIMO) by two passes of oligo dT chromatography, as described by Aviv and Leder, *Proc. Natl. Acad. Sci. USA* 69:1408–1412, 1972), the entire disclosure of which is incorporated herein by reference, in order to eliminate ribosomal RNA.

The quality and the integrity of the polyA+ RNAs were checked. Northern blots hybridized with a globin probe were used to confirm that the mRNAs were not degraded. Contamination of the polyA$^+$ mRNAs by ribosomal sequences was checked using Northern blots and a probe derived from the sequence of the 28S rRNA. Preparations of mRNAs with less than 5% of rRNAs were used in library construction. To avoid constructing libraries with RNAs contaminated by exogenous sequences (prokaryotic or fungal), the presence of bacterial 16S ribosomal sequences or of two highly expressed fungal mRNAs was examined using PCR.

EXAMPLE 2

Methods for Obtaining mRNAs Having Intact 5' Ends

Figure 1:
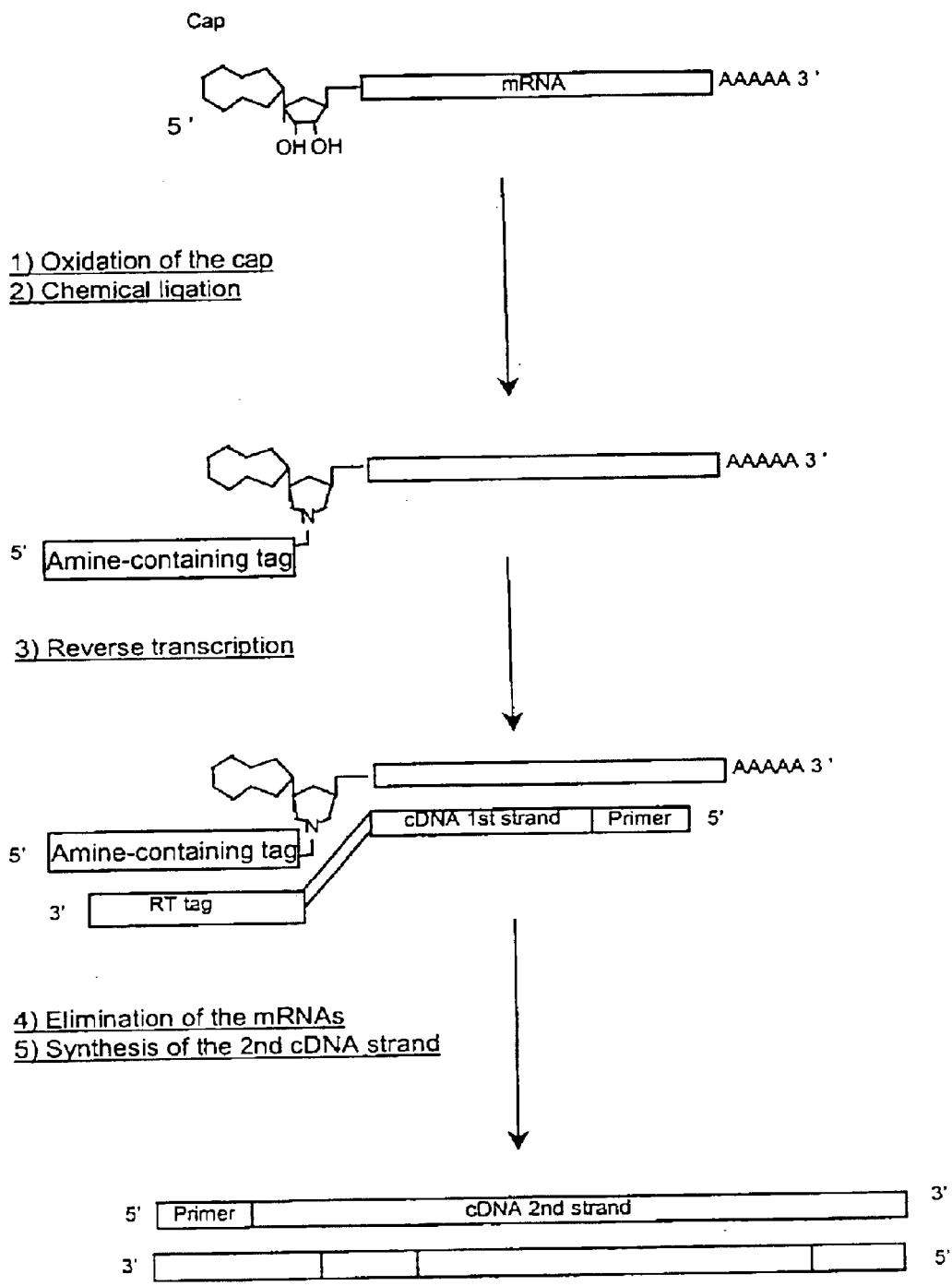
FIG. 1 is a summary of a procedure for obtaining cDNAs which have been selected to include the 5' ends of the mRNAs from which they derived. In the first step (1), the cap of intact mRNAs is oxidized to be chemically ligated to an oligonucleotide tag. In the second step (2), a reverse transcription is performed using random primers to generate a first cDNA strand. In the third step (3), mRNAs are eliminated and the second strand synthesis is carried out using a primer contained in the oligonucleotide tag.

Following preparation of the mRNAs from various tissues as described above, selection of mRNA with intact 5' ends and specific attachment of an oligonucleotide tag to the 5' end of such mRNA was performed using either a chemical or enzymatic approach. Both techniques takes advantage of the presence of the "cap" structure, which characterizes the 5' end of intact mRNAs and which comprises a guanosine generally methylated once, at the 7 position. The chemical approach is illustrated in FIG. 1.

The chemical modification approach involves the optional elimination of the 2', 3'-cis diol of the 3' terminal ribose, the oxidation of the 2', 3'-cis diol of the ribose linked to the cap of the 5' ends of the mRNAs into a dialdehyde, and the coupling of the such obtained dialdehyde to a derivatized oligonucleotide tag. Further detail regarding the chemical approaches for obtaining mRNAs having intact 5' ends are disclosed in International Application No. WO 96/34981, published Nov. 7, 1996, the entire disclosure of which is incorporated herein by reference.

The enzymatic approach for ligating the oligonucleotide tag to the 5' ends of mRNAs with intact 5' ends involves the removal of the phosphate groups present on the 5' ends of uncapped incomplete mRNAs, the subsequent decapping of mRNAs with intact 5' ends and the ligation of the phosphate present at the 5' end of the decapped mRNA to an oligonucleotide tag. Further detail regarding the enzymatic approaches for obtaining mRNAs having intact 5' ends are disclosed in Dumas Milne Edwards J. B. (Doctoral Thesis of Paris VI University, Le clonage des ADNc complets: difficultes et perspectives nouvelles. Apports pour létude de la regulation de léxpression de la tryptophane hydroxylase de rat, 20 Dec. 1993), EPO 625572 and Kato et al., *Gene* 150:243–250 (1994), the entire disclosures of which are incorporated herein by reference.

In either the chemical or the enzymatic approach, the oligonucleotide tag has a restriction enzyme site (e.g. EcoRI sites) therein to facilitate later cloning procedures. Following attachment of the oligonucleotide tag to the mRNA, the integrity of the mRNA was then examined by performing a Northern blot using a probe complementary to the oligonucleotide tag.

EXAMPLE 3 cDNA Synthesis Using mRNA Templates Having Intact 5' Ends

For the mRNAs joined to oligonucleotide tags, first strand cDNA synthesis was performed using a reverse transcriptase with random nonamers as primers. In order to protect internal EcoRI sites in the cDNA from digestion at later steps in the procedure, methylated dCTP was used for first strand synthesis. After removal of mRNA by an alkaline hydrolysis, the first strand of cDNA was precipitated using isopropanol in order to eliminate residual primers.

The second strand of the cDNA was synthesized with a Klenow fragment using a primer corresponding to the 5' end of the ligated oligonucleotide. Methylated dCTP was also used for second strand synthesis in order to protect internal EcoRI sites in the cDNA from digestion during the cloning process.

EXAMPLE 4

Cloning of cDNAs Derived from mRNA with Intact 5' ends into BlueScript

Following second strand synthesis, the ends of the cDNA were blunted with T4 DNA polymerase (Biolabs) and the cDNA was digested with EcoRI. Since methylated dCTP was used during cDNA synthesis, the EcoRI site present in the tag was the only hemi-methylated site, hence the only site susceptible to EcoRI digestion. The cDNA was then size fractionated using exclusion chromatography (AcA, Biosepra) and fractions corresponding to cDNAs of more than 150 bp were pooled and ethanol precipitated. The cDNA was directionally cloned into the SmaI and EcoRI ends of the phagemid pBlueScript vector (Stratagene). The ligation mixture was electroporated into bacteria and propagated under appropriate antibiotic selection.

EXAMPLE 5

Selection of Clones Having the Oligonucleotide Tag Attached Thereto

Clones containing the oligonucleotide tag attached were then selected as follows. The plasmid DNAs containing 5' EST libraries made as described above were purified (Qiagen). A positive selection of the tagged clones was performed as follows. Briefly, in this selection procedure, the plasmid DNA was converted to single stranded DNA using gene D endonuclease of the phage F1 in combination with an exonuclease (Chang et al., Gene 127:95–8, 1993), the entire disclosure of which is incorporated herein by reference, such as exonuclease III or T7 gene 6 exonuclease. The resulting single stranded DNA was then purified using paramagnetic beads as described by Fry et al., *Biotechniques*, 13: 124–131, 1992, the entire disclosure of which is incorporated herein by reference. In this procedure, the single stranded DNA was hybridized with a biotinylated oligonucleotide having a sequence corresponding to the 3' end of the oligonucleotide tag. Clones including a sequence complementary to the biotinylated oligonucleotide were captured by incubation with streptavidin coated magnetic beads followed by magnetic selection. After capture of the positive clones, the plasmid DNA was released from the magnetic beads and converted into double stranded DNA using a DNA polyerase such as the Thermosequenase obtained from Amersham Pharmacia Biotech. The double stranded DNA was then electroporated into bacteria. The percentage of positive clones having the 5' tag oligonucleotide was estimated using dot blot analysis to typically be between 90 and 98%.

Following electroporation, the libraries were ordered in 384-microtiter plates (MTP). A copy of the MTP was stored for future needs. Then the libraries were transferred into 96 MTP and sequenced as described below.

EXAMPLE 6

Sequencing of Inserts in Selected Clones

Plasmid inserts were first amplified by PCR on PE-9600 thermocyclers (Perkin-Elmer, Applied Biosystems Division, Foster City, Calif.), using standard SETA-A and SETA-B primers (Genset S A), AmpliTaqGold (Perkin-Elmer), dNTPs (Boehringer), buffer and cycling conditions as recommended by the Perkin-Elmer Corporation.

PCR products were then sequenced using automatic ABI Prism 377 sequencers (Perkin Elmer). Sequencing reactions were performed using PE 9600 thermocyclers with standard dye-primer chemistry and ThermoSequenase (Amersham Pharmacia Biotech). The primers used were either T7 or 21 M13 (available from Genset S A) as appropriate. The primers were labeled with the JOE, FAM, ROX and TAMRA dyes. The dNTPs and ddNTPs used in the sequencing reactions were purchased from Boehringer. Sequencing buffer, reagent concentrations and cycling conditions were as recommended by Amersham.

Following the sequencing reaction, the samples were precipitated with ethanol, resuspended in formamide loading buffer, and loaded on a standard 4% acrylamide gel. Electrophoresis was performed for 2.5 hours at 3000V on an ABI 377 sequencer, and the sequence data were collected and analyzed using the ABI Prism DNA Sequencing Analysis Software, version 2.1.2.

EXAMPLE 7

Obtaining 5' ESTs from Extended cDNA Libraries Obtained from mRNA with Intact 5' Ends Alternatively, 5' ESTs may be isolated from other cDNA or genomic DNA libraries. Such cDNA or genomic DNA libraries may be obtained from a commercial source or made using other techniques familiar to those skilled in the art One example of such cDNA library construction, a full-length cDNA library, is as follows.

PolyA+ RNAs are prepared and their quality checked as described in Example 1. Then, the caps at the 5' ends of the polyA+ RNAs are specifically joined to an oligonucleotide tag as described in Example 2. The oligonucleotide tag may contain a restriction site such as EcoRI to facilitate further subcloning procedures. Northern blotting is then performed to check the size of mRNAs having the oligonucleotide tag attached thereto and to ensure that the mRNAs are actually tagged.

First strand synthesis is subsequently carried out for mRNAs joined to the oligonucleotide tag as described in Example 3 above except that the random nonamers are replaced by an oligo-dT primer. For instance, this oligo-dT primer may contain an internal tag of 4 nucleotides which is different from one tissue to the other. Following second strand synthesis using a primer contained in the oligonucleotide tag attached to the 5' end of mRNA, the blunt ends of the obtained double stranded full-length DNAs are modified into cohesive ends to facilitate subcloning. For example, the extremities of full-length cDNAs may be modified to allow subcloning into the EcoRI and Hind III sites of a Bluescript vector using the EcoRI site of the oligonucleotide tag and the addition of a Hind III adaptor to the 3' end of full-length cDNAs.

The full-length cDNAs are then separated into several fractions according to their sizes using techniques familiar to those skilled in the art. For example, electrophoretic separation may be applied in order to yield 3 or 6 different fractions. Following gel extraction and purification, the cDNA fractions are subcloned into appropriate vectors, such as Bluescript vectors, transformed into competent bacteria and propagated under appropriate antibiotic conditions. Subsequently, plasmids containing tagged full-length cDNAs are positively selected as described in Example 5.

The 5' end of fill-length cDNAs isolated from such cDNA libraries may then be sequenced as described in Example 6 to yield 5'ESTs.

II. Computer Analysis of the Isolated 5' ESTs: Construction of the SignalTag™ Database The sequence data from the cDNA libraries made as described above were transferred to a database, where quality control and validation steps were performed. A base-caller, working using a Unix system, automatically flagged suspect peaks, taking into account the shape of the peaks, the inter-peak resolution, and the noise level. The base-caller also performed an automatic trimming. Any stretch of 25 or fewer bases having more than 4 suspect peaks was considered unreliable and was discarded. Sequences corresponding to cloning vector or ligation oligonucleotides were automatically removed from the EST sequences. However, the resulting EST sequences may contain 1 to 5 bases belonging to the above mentioned sequences at their 5' end. If needed, these can easily be removed on a case to case basis.

Following sequencing as described above, the sequences of the 5' ESTs were entered in a database for storage and manipulation as described below. Before searching the ESTs in the database for sequences of interest, ESTs derived from mRNAs which were not of interest were identified. Briefly, such undesired sequences may be of three types. First, contaminants of either endogenous (ribosomal RNAs, transfert RNAs, mitochondrial RNAs) or exogenous (prokaryotic RNAs and fungal RNAs) origins were identified. Second, uninformative sequences, namely redundant sequences, small sequences and highly degenerate sequences were identified. Third, repeated sequences (Alu, L1, THE and MER repeats, SSTR sequences or satellite, micro-satellite, or telomeric repeats) were identified and masked in further processing.

In order to determine the accuracy of the sequencing procedure as well as the efficiency of the 5' selection described above, the analyses described in Examples 8 and 9 respectively were performed on 5' ESTs obtained from the database following the elimination of endogenous and exogenous contaminants and following the masking of repeats.

EXAMPLE 8

Measurement of Sequencing Accuracy by Comparison to Known Sequences

To further determine the accuracy of the sequencing procedure described in Example 6, the sequences of 5' ESTs derived from known sequences were identified and compared to the original known sequences. First, a FASTA analysis with overhangs shorter than 5 bp on both ends was conducted on the 5' ESTs to identify those matching an entry in the public human mRNA database available at the time of filing the priority applications. The 5' ESTs which matched a known human mRNA were then realigned with their cognate mRNA and dynamic programming was used to include substitutions, insertions, and deletions in the list of "errors" which would be recognized. Errors occurring in the last 10 bases of the 5' EST sequences were ignored to avoid the inclusion of spurious cloning sites in the analysis of sequencing accuracy. This analysis revealed that the sequences incorporated in the database had an accuracy of more than 99.5%.

EXAMPLE 9

Determination of Efficiency of 5' EST Selection

To determine the efficiency at which the above selection procedures isolated 5' ESTs which included sequences close to the 5' end of the mRNAs from which they derived, the sequences of the ends of the 5' ESTs derived from the elongation factor I subunit α and ferritin heavy chain genes were compared to the known cDNA sequences of these genes. Since the transcription start sites of both genes are well characterized, they may be used to determine the percentage of derived 5' ESTs which included the authentic transcription start sites. For both genes, more than 95% of the obtained 5' ESTs actually included sequences close to or upstream of the 5' end of the corresponding mRNAs.

To extend the analysis of the reliability of the procedures for isolating 5' ESTs from ESTs in the database, a similar analysis was conducted using a database composed of human mRNA sequences extracted from GenBank database release 97 for comparison. The 5' ends of more than 85% of 5' ESTs derived from mRNAs included in the GenBank database were located close to the 5' ends of the known sequence. As some of the mRNA sequences available in the GenBank database are deduced from genomic sequences, a 5' end matching with these sequences will be counted as an internal match. Thus, the method used here underestimates the yield of ESTs including the authentic 5' ends of their corresponding mRNAs.

EXAMPLE 10

Calculation of Novelty Indices for 5' EST Libraries

In order to evaluate the novelty of 5' EST libraries, the following analysis was performed. For each sequenced 5'

EST library, the sequences were clustered by the 5' end. Each sequence in the library was compared to the others and the longest sequence found in the cluster was used as representative of the group. A novelty rate (NR) was then defined as: NR=100×(Number of new unique sequences found in the library/Total number of sequences from the library). Typically, novelty rating ranged between 10% and 41% depending on the tissue from which the 5'EST library was obtained. For most of the libraries, the random sequencing of 5' EST libraries was pursued until the novelty rate reached 20%.

EXAMPLE 11

Generation of Consensus Contigated 5' ESTs

Since the cDNA libraries made above include multiple 5' ESTs derived from the same mRNA, overlapping 5'ESTs may be assembled into continuous sequences. The following method describes how to efficiently align multiple 5'ESTs in order to yield not only consensus contigated 5'EST sequences for mRNAs derived from different genes but also consensus contigated 5'EST sequences for different mRNAs, so called variants, transcribed from the same gene such as alternatively spliced mRNAs.

The whole set of sequences was first partitioned into small clusters containing sequences which exhibited perfect matches with each other on a given length and which derived from a small number of different genes. Some 5'EST sequences, so called singletons, were not aligned using this approach because they were not homologous to any other sequence.

Thereafter, all variants of a given gene were identified in each cluster using a proprietary software. 5'EST sequences belonging to the same variant were then contigated and consensus contigated 5'EST sequences generated for each variant. All consensus contigated 5'EST sequences were subsequently compared to the whole set of individual 5'EST sequences used to obtained them.

If desired, the consensus contigated 5'EST sequences may be verified by identifying clones in nucleic acid samples derived from biological tissues, such as cDNA libraries, which hybridize to the probes based on the sequences of the consensus contigated 5'ESTs using any methods described herein and sequencing those clones.

Application of this alignment method to a selected set of 5'ESTs free from endogenous contaminants and uninformative sequences, and following the masking of repeats, yielded consensus contigated 5'EST sequences or variants of clustered genes encompassing many individual 5'ESTs. Both non aligned 5'ESTs, i.e. singletons, and consensus contigated 5'ESTs were then compared to already known sequences and those sequences matching human mRNA sequences were eliminated from further analysis.

EXAMPLE 12

Identification of Open Reading Frames in 5' ESTs

Subsequently, consensus contigated 5'ESTs and 5'ESTs were screened to identify those having an open reading frame (ORF).

Such open reading frames were simply defined as uninterrupted nucleic acid sequences longer than 45 nucleotides and beginning with an ATG codon.

Alternatively, the nucleic acid sequence was first divided into several subsequences which coding propensity was evaluated separately using one or several different methods known to those skilled in the art such as the evaluation of N-mer frequency and its variants (Fickett and Tung, *Nucleic Acids Res*; 20:6441–50 (1992)), the entire disclosure of which is incorporated herein by reference, or the Average Mutual Information method (Grosse et al, International Conference on Intelligent Systems for Molecular Biology, Montreal, Canada. Jun. 28–Jul. 1, 1998), the entire disclosure of which is incorporated herein by reference. Each of the scores obtained by the techniques described above were then normalized by their distribution extremities and then fused using a neural network into a unique score that represents the coding probability of a given subsequence. The coding probability scores obtained for each subsequence, thus the probability score profiles obtained for each reading frame, was then linked to the initiation codons present on the sequence. For each open reading frame, defined as a nucleic acid sequence beginning with an ATG codon, an ORF score was determined. Preferably, this score is the sum of the probability scores computed for each subsequence corresponding to the considered ORF in the correct reading frame corrected by a function that negatively accounts for locally high score values and positively accounts for sustained high score values. The most probable ORF with the highest score was selected.

In some embodiments, nucleic acid sequences encoding an "incomplete ORF", as referred therein, namely an open reading frame in which a start codon has been identified but no stop codon has been identified, were obtained.

In other embodiments, nucleic acid sequences encoding a "complete ORF", as used therein, namely an open reading frame in which a start codon and a stop codon have been identified, are obtained.

In a preferred embodiment, open reading frames encoding polypeptides of at least 50 amino acids were obtained.

To confirm that the chosen ORF actually encodes a polypeptide, the consensus contigated 5'EST or 5'EST may be used to obtain an extended cDNA using any of the techniques described therein, and especially those described in Examples 19 and 20. Then, such obtained extended cDNAs may be screened for the most probable open reading frame using any of the techniques described therein. The amino acid sequence of the ORF encoded by the consensus contigated 5'EST or 5'EST may then be compared to the amino acid sequence of the ORF encoded by the extended cDNA using any of the algorithms and parameters described therein in order to determine whether the ORF encoded by the extended cDNA is basically the same as the one encoded by the consensus contigated 5'EST or 5'EST.

Alternatively, to confirm that the chosen ORF actually encodes a polypeptide, the consensus contigated 5'EST or 5'EST may be used to obtain an extended cDNA using any of the techniques described therein, and especially those described in Examples 19 and 20. Such an extended cDNA may then be inserted into an appropriate expression vector and used to express the polypeptide encoded by the extended cDNA as described therein. The expressed polypeptide may be isolated, purified, or enriched as described therein. Several methods known to those skilled in the art may then be used to determine whether the expressed polypeptide is the one actually encoded by the chosen ORF, therein referred to an the expected polypeptide. Such methods are based on the determination of predictable features of the expressed polypeptide, including but not limited to its amino acid sequence, its size or its charge, and the comparison of these features to those predicted for the expected polypeptide. The following paragraphs present examples of such methods.

One of these methods consists in the determination of at least a portion of the amino acid sequence of the expressed polypeptide using any technique known to those skilled in the art. For example, the amino-terminal residues may be determined using techniques either based on Sanger's technique of acid hydrolysis of a polypeptide which N-terminal residue has been covalently labeled or using techniques based on Ednian degradation of polypeptides which N-terrrinal residues are sequentially labeled and cleaved from the polypeptide of interest The amino acid sequence of the expressed polypeptide may then be compared to the one predicted for the expected polypeptide using any algorithm and parameters described therein.

Alternatively, the size of the expressed polypeptides may be determined using techniques familiar to those skilled in the art such as Coomassie blue or silver staining and subsequently compared to the size predicted for the expected polypeptide. Generally, the band corresponding to the expressed polypeptide will have a mobility near that expected based on the number of amino acids in the open reading frame of the extended cDNA. However, the band may have a mobility different than that expected as a result of modifications such as glycosylation, ubiquitination, or enzymatic cleavage.

Alternatively, specific antibodies or antipeptides may be generated against the expected polypeptide as described in Example 34 and used to perform immunoblotting or immunoprecipitation studies against the expressed polypeptide. The presence of a band in samples from cells containing the expression vector with the extended cDNA which is absent in samples from cells containing the expression vector encoding an irrelevant polypeptide indicates that the expected polypeptide or portion thereof is being expressed. Generally, the band corresponding to the expressed polypeptide will have a mobility near that expected based on the number of amino acids in the open reading frame of the extended cDNA. However, the band may have a mobility different than that expected as a result of modifications such as glycosylation, ubiquitination, or enzymatic cleavage

EXAMPLE 13

Identification of Potential Signal Sequences in 5' ESTs

The 5'ESTs or consensus contigated 5'ESTs found to encode an ORF were then searched to identify potential signal motifs using slight modifications of the procedures disclosed in Von Heijne, *Nucleic Acids Res.* 14:4683–4690, 1986, the entire disclosure of which is incorporated herein by reference. Those sequences encoding a 15 amino acid long stretch with a score of at least 3.5 in the Von Heijne signal peptide identification matrix were considered to possess a signal sequence. Those nucleic acid sequences which match a known human mRNA or EST sequence and have a 5' end located downstream of the known 5' end, preferably by more than 20 nucleotides, were excluded from further analysis. The remaining nucleic acids having signal sequences therein were included in a database called SignalTag™.

EXAMPLE 14

Confirmation of Accuracy of Identification of Potential Signal Sequences in 5' ESTs The accuracy of the above procedure for identifying signal sequences encoding signal peptides was evaluated by applying the method to the 43 amino acids located at the N terminus of all human SwissProt proteins. The computed Von Heijne score for each protein was compared with the known characterization of the protein as being a secreted protein or a non-secreted protein. In this manner, the number of non-secreted proteins having a score higher than 3.5 (false positives) and the number of secreted proteins having a score lower than 3.5 (false negatives) could be calculated.

Using the results of the above analysis, the probability that a peptide encoded by the 5' region of the mRNA is in fact a genuine signal peptide based on its Von Heijne's score was calculated based on either the assumption that 10% of human proteins are secreted or the assumption that 20% of human proteins are secreted. The results of this analysis are shown in FIG. 2.

Using the above method of identification of secretory proteins, 5' ESTs of the following polypeptides known to be secreted were obtained: human glucagon, gamma interferon induced monokine precursor, secreted cyclophilin-like protein, human pleiotropin, and human biotinidase precursor. Thus, the above method successfully identified those 5' ESTs which encode a signal peptide.

To confirm that the signal peptide encoded by the 5' ESTs or consensus contigated 5' ESTs actually functions as a signal peptide, the signal sequences from the 5' ESTs or consensus contigated 5' ESTs may be cloned into a vector designed for the identification of signal peptides. Such vectors are designed to confer the ability to grow in selective medium only to host cells containing a vector with an operably linked signal sequence. For example, to confirm that a 5' EST or consensus contigated 5' EST encodes a genuine signal peptide, the signal sequence of the 5' EST or consensus contigated 5' EST may be inserted upstream and in frame with a non-secreted form of the yeast invertase gene in signal peptide selection vectors such as those described in U.S. Pat. No. 5,536,637, the entire disclosure of which is incorporated herein by reference. Growth of host cells containing signal sequence selection vectors with the correctly inserted 5' EST or consensus contigated 5' EST signal sequence confirms that the 5' EST or consensus contigated 5' ESTs encodes a genuine signal peptide.

Alternatively, the presence of a signal peptide may be confirmed by cloning the extended cDNAs obtained using the ESTs or consensus contigated 5' ESTs into expression vectors such as pXT1 as described below, or by constructing promoter-signal sequence-reporter gene vectors which encode fusion proteins between the signal peptide and an assayable reporter protein. After introduction of these vectors into a suitable host cell, such as COS cells or NIH 3T3 cells, the growth medium may be harvested and analyzed for the presence of the secreted protein. The medium from these cells is compared to the medium from control cells containing vectors lacking the signal sequence or extended cDNA insert to identify vectors which encode a functional signal peptide or an authentic secreted protein.

EXAMPLE 15

Analysis of the Sequences of the Invention

The set of the nucleic acid sequences of the invention (SEQ ID NOs.24–811 and 1600–1622) was obtained as described in Example 11. Subsequently, the most probable open reading frame was determined and signal sequences were searched, as described in Examples 12 and 13, for all sequences of the invention.

The nucleotide sequences of the SEQ ID NOs. 24–811 and 1600–1622 and the polypeptides sequences encoded by SEQ ID NOs. 24–811 (i.e. polypeptide sequences of SEQ ID NOs. 812–1599) are provided in the appended sequence listing which structure is as follows.

SEQ ID NOs. 24–728 are nucleic acids having an incomplete ORF which encodes a signal peptide. The locations of the incomplete ORFs and sequences encoding signal peptides are listed in the accompanying Sequence Listing. In addition, the von Heijne score of the signal peptide computed as described in Example 13 is listed as the "score" in the accompanying Sequence Listing. The sequence of the signal-peptide is listed as "seq" in the accompanying Sequence Listing. The "/" in the signal peptide sequence indicates the location where proteolytic cleavage of the signal peptide occurs to generate a mature protein.

SEQ ED NOs. 729–765 are nucleic acids having an incomplete ORF in which no sequence encoding a signal peptide has been identified to date. However, it remains possible that subsequent analysis will identify a sequence encoding a signal peptide in these nucleic acids. The locations of the incomplete ORFs are listed in the accompanying Sequence Listing.

SEQ ID NOs. 766–792 are nucleic acids having a complete ORF which encodes a signal peptide. The locations of the complete ORFs and of the signal peptides, the von Heijne score of the signal peptide, the sequence of the signal-peptide and the proteolytic cleavage site are indicated as is described above.

SEQ ID NOs. 793–811 are nucleic acids having a complete ORF in which no sequence encoding a signal peptide has been identified to date. However, it remains possible that subsequent analysis will identify a sequence encoding a signal peptide in these nucleic acids. The locations of the complete ORFs are listed in the accompanying Sequence Listing.

SEQ ID NOs. 812–1516 are "incomplete polypeptide sequences" which include a signal peptide. "Incomplete polypeptide sequences" are polypeptide sequences encoded by nucleic acids in which a start codon has been identified but no stop codon has been identified. These polypeptides are encoded by the nucleic acids of SEQ ID NOs. 24728. The location of the signal peptide, the von Heijne score of the signal peptide, the sequence of the signal-peptide and the proteolytic cleavage site are indicated as described above.

SEQ ID NOs. 1517–1553 are incomplete polypeptide sequences in which no signal peptide has been identified to date. However, it remains possible that subsequent analysis will identify a signal peptide in these polypeptides. These polypeptides are encoded by the nucleic acids of SEQ ID NOs. 729–765.

SEQ ID NOs. 1554–1580 are "complete polypeptide sequences" which include a signal peptide. "Complete polypeptide sequences" are polypeptide sequences encoded by nucleic acids in which a start codon and a stop codon have been identified. These polypeptides are encoded by the nucleic acids of SEQ ID NOs. 766–792. The location of the signal peptide, the von Heijne score of the signal peptide, the sequence of the signal-peptide and the proteolytic cleavage site are indicated as described above.

SEQ'ID NOs. 1581–1599 are complete polypeptide sequences in which no signal peptide has been identified to date. However, it remains possible that subsequent analysis will identify a signal peptide in these polypeptides. These polypeptides are encoded by the nucleic acids of SEQ ID NOs.793–811.

SEQ ID NOs. 1600–1622 are nucleic acid sequences in which no open reading frame has been conclusively identified to date. However, it remains possible subsequent analysis will identify an open reading frame in these nucleic acids.

In the accompanying Sequence Listing, all instances of the symbol "n" in the nucleic acid sequences mean that the nucleotide can be adenine, guanine, cytosine or thymine. In some instances the polypeptide sequences in the Sequence Listing contain the symbol "Xaa." These "Xaa" symbols indicate either (1) a residue which cannot be identified because of nucleotide sequence ambiguity or (2) a stop codon in the determined sequence where applicants believe one should not exist (if the sequence were determined more accurately). In some instances, several possible identities of the unknown amino acids may be suggested by the genetic code.

In the case of secreted proteins, it should be noted that, in accordance with the regulations governing Sequence Listings, in the appended Sequence Listing, the full protein (i.e. the protein containing the signal peptide and the mature protein) extends from an amino acid residue having a negative number through a positively numbered C-terminal amino acid residue. Thus, the first amino acid of the mature protein resulting from cleavage of the signal peptide is designated as amino acid number 1, and the first amino acid of the signal peptide is designated with the appropriate negative number.

If one of the nucleic acid sequences of SEQ ID NOs. 24–811 and 1600–1622 are suspected of containing one or more incorrect or ambiguous nucleotides, the ambiguities can readily be resolved by resequencing a fragment containing the nucleotides to be evaluated. If one or more incorrect or ambiguous nucleotides are detected, the corrected sequences should be included in the clusters from which the sequences were isolated, and used to compute other consensus contigated sequences on which other ORFs would be identified. Nucleic acid fragments for resolving sequencing errors or ambiguities may be obtained from deposited clones or can be isolated using the techniques described herein. Resolution of any such ambiguities or errors may be facilitated by using primers which hybridize to sequences located close to the ambiguous or erroneous sequences. For example, the primers may hybridize to sequences within 50–75 bases of the ambiguity or error. Upon resolution of an error or ambiguity, the corresponding corrections can be made in the protein sequences encoded by the DNA containing the error or ambiguity. The amino acid sequence of the protein encoded by a particular clone can also be determined by expression of the clone in a suitable host cell, collecting the protein, and determining its sequence.

In addition, if one of the sequences of SEQ ID NOs. 812–1599 is suspected of containing a truncated ORF as the result of a frameshift in the sequence, such frameshifting errors may be corrected by combining the following two approaches. The first one involves thorough examination of all double predictions, i.e. all cases where the probability scores for two ORFs located on different reading frames are high and close, preferably different by less than 0.4. The fine examination of the region where the two possible ORFs overlap may help to detect the frameshift. In the second approach, homologies with known proteins are used to correct suspected frameshifts.

Of the identified clusters, some were shown to be multivariant, i.e. to contain several variants of the same gene. Table I gives for each of the multivariant clusters named by its internal reference (first column), the list of all variant consensus contigated 5'ESTs (second column), each being represented by a different sequence identification number.

TABLE I

| Cluster Internal Reference | SEQ ID NOs of Variants |
|---|---|
| C1 | 687, 791 |
| C2 | 744, 798 |
| C3 | 640, 811 |
| C4 | 59, 66 |
| C5 | 84, 97 |
| C6 | 287, 289 |
| C7 | 286, 775, 777 |
| C8 | 762, 768 |
| C9 | 783, 784 |
| C10 | 80, 1603 |
| C11 | 655, 736 |
| C12 | 805, 806 |

Table II provides a list preferred polynucleotide fragments which are derivatives of the consensus contigated 5'ESTs. As used herein the term "polynucleotide described in Table II" refers to the all of the preferred polynucleotide fragments defined in Table II in the following manner. The fragments are referred to by their SEQ ID numbers in the first column. The preferred polynucleotide fragments are then defined by a range of nucleotide positions from the SEQ IDs of the consensus contigated 5'ESTs as indicated in the second column entitled "positions of preferred fragments." The preferred polynucleotide fragments correspond to the individual 5'ESTs aligned to obtain the consensus contigated 5' EST and to those filed in the priority documents. The third column entitled "variant nucleotides" describes the nucleotide sequence variations observed between the consensus contigated 5'EST and preferred nucleic acid fragments as follows:

A) Substitutions in the sequence of a consensus contigated 5'EST to derive a preferred polynucleotide fragment are denoted by an "S", followed by a number indicating the first nucleotide position in a specific SEQ ID to be substituted in a string of substituted nucleotides or the position of the substituted nucleotide in the case of a single substituted nucleotide. Then there is a coma followed by one or more lower case letters indicating the identity of the nucleotide(s) occurring in the substituted position(s). For example, SEQ ID NO: 3401; Position of preferred fragments: 1–250; Variant nucleotides S45, atc would indicate that a preferred polynucleotide fragment had the sequence of positions 1 to 250 of SEQ ID NO. 3401, except that the nucleotides at positions 45, 46, and 47 were substituted with A, T, and C, respectively, in the preferred polynucleotide as compared with the sequence of SEQ ID No. 3401.

B) Insertions in the sequence of a consensus contigated 5'EST to derive a preferred polynucleotide fragment are denoted by an "I", followed by a number indicating the nucleotide position in a specific SEQ ID after which a string of nucleotides is inserted or the position after which the nucleotide is inserted in the case of a single inserted nucleotide. Then there is a coma followed by one or more lower case letters indicating the identity of the nucleotide(s) occurring in the inserted position(s). For example, SEQ ID NO: 7934; Position of preferred fragments: 1–500; Variant nucleotides: I36, gataca would indicate that a preferred polynucleotide fragment had the sequence of positions 1 to 500 of SEQ ID NO. 7934, except that after the nucleotides at position 36 a GATACA string of nucleotides is inserted in the preferred polynucleotide as compared with the sequence of SEQ ID No. 7934.

C) Deletions in the sequence of a consensus contigated 5' EST to derive a preferred nucleic acid fragment are denoted by an "D", followed by a number indicating the first nucleotide position in a specific SEQ ID to be deleted in a string of deleted nucleotides or the position of the deleted nucleotide in the case of a single deleted nucleotide. Then there is a coma followed by number indicating the number of nucleobde(s) deleted from the sequence provided in the sequence ID. For example, SEQ ID NO: 5398; Position of preferred fragments: 56–780; Variant nucleotides D114,5 would indicate that a preferred polynucleotide fragment had the sequence of positions 56 to 780 of SEQ ID NO. 5398, except that the nucleotides in positions 114 to 118 had been deleted in the preferred polynucleotide as compared with the sequence of SEQ ID No. 5398.

The present invention encompasses isolated, purified, or recombinant nucleic acids which consist of, consist essentially of, or comprise a contiguous span of at least 8, 10, 12, 15, 18, 20, 25, 35, 40, 50, 70, 80, 100, 250, or 500 nucleotides in length, to the extent that a contiguous span of these lengths is consistent with the lengths of the particular polynucleotide, of a polynucleotide described in Table II, or a sequence complementary thereto, wherein said polynucleotide described in Table II is selected individually or in any combination from the polynucleotides described in Table II. The present invention also encompasses isolated, purified, or recombinant nucleic acids which consist of or consist essentially of a polynucleotide described in Table II, or a sequence complementary thereto, wherein said polynucleotide is selected individually or in any combination from the polynucleotides described in Table II. The present invention further encompasses isolated or purified polypeptides which consist of, consist essentially of, or comprise a contiguous span of at least 8, 10, 12, 15, 18, 20, 25, 35, 40, 50, 70, 80, or 100 amino acids encoded by a polynucleotide described in Table II.

TABLE II

| SEQ ID NO. | Positions of Preferred Fragments | Variant nucleotides |
|---|---|---|
| 35 | 1–423 | S124, s; I135, a; S293, w; I363, a; S377, r; D424, 15 |
| 41 | 1–427 | I117, m; S120, r; S124, g; D373, l; S376, b; S378, b; I427, gggg; D428, 109 |
| 43 | 1–276 | S114, m; S118, rg; S123, r; S139, nr; I142, t; D148, 1; D152, 1; I228, t; I276, gg; D277, 136 |
| 45 | 126–420 | D1, 125; I420, ggg; D421, 100 |
| 46 | 1–255 | S139, r; I145, r; S146, mm; S150, ar; S254, g; D256, 128 |
| 48 | 4–437 | D1, 3; S49, a; S55, g; S79, a; S90, a; I437, tctctg |
| 59 | 1–471 | S26, a; S44, t; S48, t; S109, a; S191, t; S200, gc; S203, a; S210, g; S237, a; S240, g; S255, a; S272, a; S277, a; S279, a; S284, t; S297, g; S305, g; S316, a; I471, ggtca |
| 66 | 1–428 | I428, tactgggg |
| 82 | 1–399 | S251, t; S277, d; I399, aagccggg |
| 84 | 5–488 | D1, 4; S210, g; S293, a; S325, g; S339, a; S348, g; S353, g; S395, g; I488, cacca |
| 93 | 1–508 | I508, gattt |
| 96 | 26–315 | D1, 25; S28, a; S62, c; I315, cagatgg |
| 97 | 4–460 | D1, 3; S19, g; S31, g; S114, gt; S118, a; S123, tc; S127, c; S132, a; S186, g; S190, c; S203, t; S210, g; S232, c; I460, acgtt |

TABLE II-continued

| SEQ ID NO. | Positions of Preferred Fragments | Variant nucleotides |
|---|---|---|
| 105 | 1–281 | S273, a; I281, g; D282, 211 |
| 114 | 10–315 | I0, t; D1, 9; S91, m; S267, n; S276, w; S292, h; S295, m; I315, tggg; D316, 19 |
| 118 | 1–145 | S57, d; S126, d; I145, ccctc |
| 120 | 2–348 | D1, 1; S104, t; I348, g; D349, 38 |
| 121 | 1–190 | I121, c; I190, ccctt |
| 123 | 1–353 | I117, m; I186, w; S187, y; I353, caccgggg |
| 124 | 1–249 | I249, ggrvgggg |
| 125 | 114–375 | D1, 113; S206, wn; I231, a; I375, ccctagg |
| 126 | 1–437 | S297, cc; S307, tg; S312, a; S318, g; S341, a; S351, t; S353, g; S383, c; S387, a; D404, 1 |
| 136 | 82–428 | D1, 81; I428, aaagtg |
| 139 | 1–268 | I268, gggaaggg |
| 148 | 6–405 | D1, 5; I405, ggtgt |
| 159 | 1–230 | S227, ta; I230, ccctggg |
| 165 | 3–256 | I0, tat; D1, 2; I17, c; S18, t; S111, d; I115, t; S123, r; I256, aaggcggg |
| 170 | 1–280 | I103, t; S104, c; I111, t; I280, cgttcggg |
| 194 | 1–215 | S50, s; S186, sn; S199, k; I215, gcagcggg |
| 213 | 1–158 | S128, m; I132, w; S143, d; I158, tgcccggg |
| 223 | 3–431 | D1, 2; S28, s; S79, c; S82, s; S308, nr; S328, nb; I431, ccgc |
| 247 | 1–359 | I76, gttt; I359, tccctgg |
| 258 | 1–236 | S72, r; S81, g; S197, s; S205, ss; S232, k; I236, acttcggg |
| 264 | 5–283 | D1, 4; S64, g; S122, m; S134, yy; I137, c; I151, t; I283, gttgc |
| 269 | 1–143 | S111, s; I143, gggggggg |
| 286 | 5–207 | D1, 4; S204, a; S206, c; I207, gg; D208, 567 |
| 287 | 1–277 | S114, r; S125, t; S131, ag; S256, tg; S259, tt; S262, at; S267, t; S269, c; S273, c; I277, ccggg; D278, 337 |
| 289 | 69–416 | D1, 68; I416, agccaggg |
| 289 | 1–278 | S114, r; S125, t; S131, ag; S277, c; I278, cggg; D279, 138 |
| 292 | 20–254 | D1, 19; I254, aaagagg |
| 293 | 1–414 | I414, tagcag |
| 300 | 1–285 | S16, m; S67, y; I285, baccacggg; D286, 1 |
| 349 | 23–431 | D1, 22; I118, a; S214, y; I431, caactctg |
| 350 | 3–386 | D1, 2; S42, w; I263, c; I386, gggat |
| 368 | 3–446 | D1, 2; I446, tctct |
| 385 | 1–193 | I35, t; I108, t; I134, r; S135, a; S137, r; S143, w; I178, c; I193, gagcgggg |
| 411 | 6–391 | D1, 5; S17, r; S27, t; S334, y; D392, 244 |
| 412 | 1–185 | S49, s; S127, s; I185, gctggg; D186, 150 |
| 415 | 2–229 | D1, 1; 53, a; I229, caaatggg |
| 435 | 1–386 | S4, s; I386, ccggg |
| 436 | 4–472 | D1, 3; S61, sa; D238, 1; S239, s; I472, agtgtgg |
| 437 | 1–340 | I340, ggg; D341, 129 |
| 441 | 1–409 | S109, smag; I409, cgcacggg |
| 454 | 1–492 | S72, nn; S115, t; S121, bwy; S181, yn; I492, gagtc |
| 455 | 1–177 | I14, w; I16, a; I177, gagctggg |
| 459 | 1–311 | S39, n; S74, rg; I311, accatggg |
| 460 | 1–425 | I425, agtac |
| 461 | 5–420 | D1, 4; I420, tcgtc |
| 481 | 1–429 | I10, w; S262, d; S333, n; I429, ctccaggg |
| 489 | 1–414 | D72, 1; S117, n; S396, d; I414, ggaca |
| 496 | 1–215 | I215, ttttcggg |
| 501 | 1–430 | S275, n; I430, aggat |
| 502 | 91–413 | D1, 90; I413, aaacgggg |
| 504 | 21–420 | D1, 20; S47, w; S83, n; S280, n; S281, na; S292, v; S314, sm; S368, ww; S373, w; I420, cccca |
| 505 | 18–457 | D1, 17; D36, 1; S182, g; S273, n; S283, a; S416, bh; I457, ctcga |
| 514 | 1–303 | I303, accca |
| 515 | 1–455 | S11, t; I12, n; S30, r; S256, wr; I333, t; I455, cataa |
| 517 | 24–453 | D1, 23; I453, agagcggg |
| 519 | 1–275 | I119, gt; S125, w; I129, w; S133, k; S137, k; S167, k; I275, gcccc |
| 522 | 1–313 | I313, agcgtggg |
| 526 | 4–366 | I0, t; D1, 3; I366, ggcccggg |
| 530 | 1–434 | S328, g; I434, aagat |
| 535 | 1–379 | S128, g; S162, m; D380, 5 |
| 561 | 2–341 | D1, 1; I341, raagagg |
| 568 | 1–246 | I118, g; S137, g; I246, aaaccggg |
| 570 | 1–207 | I207, tttttt |
| 576 | 1–288 | I34, c; I288, cccgtgg |
| 588 | 1–390 | S218, a; S224, k; S314, dh; S358, s; S376, 1; I390, atg; D391, 23 |
| 597 | 31–274 | D1, 30; S49, n; I274, tccatgg |
| 606 | 1–354 | I141, g; I174, 1; S229, rr; D355, 72 |
| 627 | 1–415 | S7, a; I415, cattt |
| 634 | 1–178 | D179, 212 |
| 640 | 6–428 | D1, 5; D429, 79 |
| 641 | 64–483 | D1, 63; I165, d; D183, 1; S185, y; S253, t; D279, 2; S416, a; I483, atata |
| 655 | 1–280 | S58, c; I84, g; S88, k; S204, ac; S244, g; S247, g; I280, ggg; D281, 90 |
| 672 | 34–489 | D1, 33; S316, k; S331, k; S333, w; S486, g; S488, c; D490, 4 |
| 687 | 116–473 | D1, 115; S142, n; I473, cctcggg |
| 697 | 1–202 | S142, s; S144, sr; S148, d; S152, d; I155, a; I164, a; S174, k; I202, gcc; D203, 291 |
| 708 | 8–384 | D1, 7; S104, b; I384, gaaaa |
| 710 | 1–167 | S40, k; S49, db; I167, tatct |
| 722 | 1–191 | I125, c; I191, ttttt |
| 723 | 1–316 | I316, aggg; D317, 157 |
| 729 | 15–373 | D1, 14; S139, t; I373, cgcag; D374, 99 |
| 730 | 29–372 | D1, 28; I155, g; S192, ka; S333, d; I372, m; D373, 93 |
| 731 | 1–290 | S10, kk; S30, b; S32, t; S92, t; S197, dy; S278, g; I290, aggg; D291, 55 |
| 732 | 8–277 | D1, 7; I113, a; S127, w; I131, s; S132, r; S156, w; S160, r; S211, n; S215, w; I247, a; D278, 121 |
| 733 | 20–375 | D1, 19; S306, sbs; I325, h; S326, nr; S338, ywd; S344, v; I375, aggg; D376, 68 |
| 734 | 1–359 | D66, 1; I360, 14 |
| 735 | 25–322 | D1, 24; S30, r; I193, a; I322, ccaaggg |
| 736 | 9–181 | D1, 8; S58, g; I181, aactaggg |
| 737 | 1–160 | S97, ta; I160, aggtc |
| 738 | 1–227 | D228, 7 |
| 739 | 45–514 | D1, 44; S178, s; I182, c; S436, dmn; S461, v; S476, c; S506, t; D515, 75 |
| 740 | 11–388 | D1, 10; I388, cgacaggg |
| 741 | 1–478 | S118, s; S125, a; I126, s; S134, k; S421, vn; I478, aatsc |
| 742 | 217–553 | I0, tt; D1, 216; S286, r; S294, m; S311, r; S317, s; S338, r; S442, dm; S469, h; S476, r; S485, s; S491, w; I495, ht; S496, v; S513, r; D521, 1; S536, m; D554, 199 |
| 743 | 1–459 | I11, s; S258, m; I270, m; I304, c; I308, amta; S313, c; S438, v; I459, agggag |
| 744 | 25–316 | D1, 24; S315, g; D317, 95 |
| 745 | 21–283 | D1, 20; I40, g; S41, c; S123, 1; S181, sr; S227, r; I283, ccgcg; D284, 121 |
| 746 | 1–256 | D257, 173 |
| 747 | 1–179 | S134, w; S138, w; S140, kt; I179, cacca |
| 748 | 1–235 | S46, t; I72, t; S189, cc; S222, c; D236, 148 |
| 749 | 2–370 | D1, 1; S32, g; D144, 1; S341, g; D371, 76 |
| 750 | 18–410 | I0, aag; D1, 17; I410, aatcc |
| 751 | 22–355 | D1, 21; I148, 1; S150, c; S152, a; S313, n; D356, 181 |
| 752 | 1–139 | S50, t; I118, g; I139, ccct |
| 753 | 1–189 | S26, r; S115, s; I121, r; S122, r; S128, s; S143, r; I146, w; S156, r; D190, 4 |
| 754 | 1–395 | S212, wd; I395, cggca |
| 755 | 19–460 | D1, 18; S26, c; S156, a; S253, n; I460, tagaagg |
| 756 | 2–142 | D1, 1; I106, gc; S107, t; S110, c; I142, ccaccggg |
| 757 | 28–296 | D1, 27; I119, s; S122, t; S128, s; S255, t; S267, m; D297, 66 |
| 758 | 11–368 | D1, 10; I200, g; S201, c; S281, d; S317, c; I368, ccatcggg |
| 759 | 19–452 | D1, 18; S421, w; I452, a |
| 760 | 25–175 | D1, 24; S34, yk; I175, ccggg; D176, 120 |
| 761 | 1–212 | I212, cactcggg |

TABLE II-continued

| SEQ ID NO. | Positions of Preferred Fragments | Variant nucleotides |
|---|---|---|
| 762 | 1–374 | S320, s; S349, a; D375, 249 |
| 763 | 8–152 | D1, 7; I152, acggg; D153, 109 |
| 764 | 1–160 | I127, g; I145, g; I160, cgcccggg |
| 765 | 137–313 | D1, 136; S272, m; I279, s; S310, t; I313, ggg; D314, 203 |
| 766 | 1–320 | S278, ag; S281, cagacc; S288,ta; S291, caag; S296, c; S317, m; I320, cggg; D321, 306 |
| 767 | 6–336 | I0, aa; D1, 5; S149, w; S245, y; D337, 137 |
| 768 | 1–374 | S320, s; D375, 299 |
| 769 | 53–435 | D1, 52; S59, b; S344, nnkw; D436, 104 |
| 770 | 24–448 | D1, 23; S25, g; S411, w; S416, m; D449, 31 |
| 771 | 1–370 | S3, c; S180, m; S275, r; D371, I22 |
| 772 | 1–388 | I299, c; S326, c; D389, 8 |
| 773 | 1–143 | S18, c; S66, a; I143, ggg; D144, 274 |
| 774 | 1–347 | S194, a; S205, c; I347, ggg; D348, 107 |
| 775 | 5–207 | D1, 4; S111, tg; S158, g; S171, c; S191, a; S204, a; S206, c; I207, gg; D208, 324 |
| 776 | 1–368 | I200, c; S201, a; S291, ta; I332, c |
| 777 | 5–207 | D1, 4; S204, a; S206, c; I207, gg; D208, 262 |
| 778 | 39–342 | D1, 38; S184, r; D343, 126 |
| 779 | 4–360 | D1, 3; S13, m; S15, c; S22, s; S24, m; S48, r; S56, s; S335, c; S345, rs; I360, ggg; D361, 119 |
| 780 | 1–472 | I347, c; D473, 32 |
| 781 | 116–426 | D1, 115; S219, m; S424, g; D427, 118 |
| 782 | 1–391 | S386, k; D392, 64 |
| 783 | 1–453 | D109, 1; S110, y; S125, y; I128, g; S132, k; I453, ctctc |
| 784 | 29–494 | D1, 28; S72, r; D495, 93 |
| 785 | 99–461 | D1, 98; S218, r; I461, gaccgggg |
| 786 | 2–465 | D1, 1; S8, y; S388, s; I398, g; S400, t; S403, at; S417, g; D466, 24 |
| 787 | 28–271 | D1, 27; S99, t; S230, c; S266, ga; S269, c; I271, g; D272, 126 |
| 788 | 1–285 | D280, 1; I285, g; D286, 310 |
| 789 | 1–209 | S205, c; D210, 150 |
| 790 | 51–297 | D1, 50; I297, ggggg; D298, 539 |
| 791 | 113–327 | D1, 112; S218, g; I226, g; D280, 1; I327, cgcaggg; D328, 224 |
| 792 | 17–218 | D1, 16; S58, t; S217, t; I218, gggg; D219, 219 |
| 793 | 11–92 | D1, 10; S91, c; I92, a; D93, 258 |
| 794 | 9–431 | D1, 8; I431, taagt |
| 795 | 30–341 | D1, 29; I341, a; D342, 175 |
| 796 | 1–442 | S17, w; S19, wr; D35, 1; S134, t; S264, n; S322, nr; S369, s; S420, s; S422, y; I442, tcctcggg |
| 797 | 1–420 | S136, c; S150, c; I245, ccc; I420, ggagtg |
| 798 | 25–316 | D1, 24; S315, g; D317, 97 |
| 799 | 1–344 | D345, 57 |
| 800 | 7–465 | D1, 6; S59, k; S146, a; S186, km; I465, gttca |
| 801 | 121–422 | D1, 120; I269, c; S419, cc; I422, gg; D423, 207 |
| 802 | 46–477 | D1, 45; S132, bn; I477, actac |
| 803 | 15–467 | D1, 14; S45, k; S65, t; S418, ys; D452, 1; D468, 119 |
| 804 | 1–341 | S42, t; S97, d; S326, gtg; S331, tgt; S336, a; S338, c; I341, ccccggg; D342, 218 |
| 805 | 2–409 | D1, 1; S334, d; I409, aggg; D410, 161 |
| 806 | 5–384 | D1, 4; I384, actaa |
| 807 | 1–301 | S113, a; S117, c; S123, t; D128, 1; D134, 1; S282, g; S284, a; I301, gacggagggg; D302, 70 |
| 808 | 2–314 | D1, 1; S306, g; I314, ggg; D315, 121 |
| 809 | 1–394 | S53, g; S228, n; S272, vk; I301, g; I358, m; S368, nb; S375, w; I383, mm; I388, yt; I394, nhaccggg |
| 810 | 6–205 | I0, a; D1, 5; I141, t; I205, ggg; D206, 630 |
| 811 | 6–270 | D1, 5; I270, gggg; D271, 115 |
| 1600 | 1–247 | S45, m; S114, k; I122, m; S123, yc; S158, rr; S221, k; I247, ccccaggg |
| 1601 | 1–225 | S109, bm; S195, m; I225, tgcacggg |
| 1602 | 23–245 | D1, 22; D138, 1; S139, s; S242, t; S244, g; I245, g; D246, 13 |
| 1603 | 1–303 | S71, c; D277, 1; I303, ggagggg; D304, 38 |
| 1604 | 1–242 | S47, w; S50, c; S81, h; S85, d; S91, k; S106, r; I242, tgtggg; D243, 50 |
| 1605 | 2–225 | D1, 1; S20, k; S91, c; I225, ggg; D226, 132 |
| 1606 | 15–293 | D1, 14; S156, g; S193, g; I200, t; I293, acaaaggg |
| 1607 | 1–361 | S323, c; I361, cccca |
| 1608 | 1–151 | I151, taagggg; D152, 154 |
| 1609 | 1–242 | S55, s; I135, a; S152, h; I242, cagtaggg |
| 1610 | 1–196 | I151, w; S190, k; I196, cctgtgg |
| 1611 | 1–228 | S115, k; S174, rk; I228, cgtttggg |
| 1612 | 1–221 | S108, v; I221, tgatcggg |
| 1613 | 1–281 | I66, w; I137, a; D282, 79 |
| 1614 | 1–171 | S53, k; S76, k; I80, k; S81, kw; S86, r; S92, k; S126, k; I171, gccgagg |
| 1615 | 2–193 | D1, 1; S67, c; I121, s; S122, mm; S126, g; S130, r; S146, r; S156, gm; I193, cctca |
| 1616 | 1–349 | S251, ww; S259, rs; S275, k; I279, w; S285, y; S292, y; I320, m; I331, m; I338, w; I341, s; I349, accccggg |
| 1617 | 1–129 | I118, t; D130, 26 |
| 1618 | 1–184 | D9, 1; D185, 1 |
| 1619 | 1–169 | I122, t; I169, gcccaggg |
| 1620 | 1–187 | S106, k; S118, m; S122, cg; S132, k; D188, 59 |
| 1621 | 1–153 | D125, 1; I131, ttt; S152, t; I153, gg; D154, 127 |
| 1622 | 1–400 | S43, s; I126, g; I129, y; S353, d; I400, tatat |

EXAMPLE 16

Categorization of 5' ESTs and Consensus Contigated 5'ESTs

The nucleic acid sequences of the present invention (SEQ ID NOs. 24–811 and 1600–1622) were grouped based on their homology to known sequences as follows. All sequences were compared to EMBL release 57 and daily releases available at the time of filing using BLASTN. All matches with a minimum of 25 nucleotides with 90% homology were retrieved and used to compute Tables III and IV.

In some embodiments, 5'ESTs or consensus contigated 5'ESTs nucleic acid sequence do not match any known vertebrate sequence nor any publicly available EST sequence, thus being completely new.

In other embodiments, 5'ESTs or consensus contigated 5'ESTs match a known sequence. Tables III and IV gives for each sequence of the invention in this category referred to by its sequence identification number in the first column, the positions of their preferred fragments in the second column entitled "Positions of preferred fragments." As used herein the term "polynucleolide described in Table III" refers to the all of the preferred polynucleotide fragments defined in Table III in this manner, and the term "polynucleotide described in Table IV" refers to the all of the preferred polynucleotides fragments defined in Table IV in this manner. The present invention encompasses isolated, purified, or recombinant nucleic acids which consist of, consist essentially of, or comprise a contiguous span of at least 8, 10, 12, 15, 18, 20, 25, 35, 40, 50, 70, 80, 100, 250, or 500 nucleotides in length, to the extent that a contiguous span of these lengths is consistent with the lengths of the particular polynucleotide, of a polynucleotide described in Table III or Table IV, or a sequence complementary thereto, wherein said polynucleotide described in Table III or Table IV is selected individually or in any combination from the polynucleotides described in Table III or Table IV. The present invention also encompasses isolated, purified, or recombinant nucleic acids which consist of or consist essentially of a polynucleotide described in Table III or Table IV, or a sequence complementary thereto, wherein said poynucleotide is selected individually or in any combination from the polynucleotides described in Table III or Table IV.

TABLE III

| SEQ ID NO | Positions of preferred fragments |
|---|---|
| 24 | 1–251 |
| 25 | 1–83 |
| 28 | 227–276 |
| 29 | 1–27 |
| 30 | 130–242, 283–315, 365–461 |
| 32 | 314–399 |
| 33 | 89–321 |
| 34 | 1–38 |
| 35 | 1–52, 171–222 |
| 36 | 1–30, 408–441 |
| 37 | 1–138 |
| 39 | 115–140 |
| 40 | 1–97 |
| 41 | 1–112 |
| 42 | 1–177 |
| 46 | 1–38 |
| 48 | 376–400 |
| 51 | 400–466 |
| 54 | 1–259 |
| 55 | 189–320 |
| 56 | 265–457 |
| 58 | 246–469 |
| 59 | 81–123, 418–444 |
| 60 | 1–348 |
| 61 | 78–123, 418–457 |
| 62 | 386–439 |
| 63 | 1–214 |
| 64 | 109–297 |
| 65 | 1–370 |
| 66 | 92–428 |
| 68 | 1–180 |
| 69 | 165–259 |
| 70 | 1–178 |
| 71 | 1–27 |
| 72 | 1–179 |
| 73 | 1–65, 107–192 |
| 75 | 1–314 |
| 77 | 263–388 |
| 78 | 1–64 |
| 79 | 1–149 |
| 80 | 101–142, 302–380 |
| 82 | 1–192 |
| 83 | 1–398 |
| 85 | 1–290 |
| 86 | 1–118, 149–336 |
| 87 | 1–262 |
| 88 | 1–149 |
| 89 | 1–315 |
| 90 | 1–74 |
| 91 | 1–335, 364–423 |
| 92 | 1–316 |
| 93 | 338–508 |
| 94 | 179–321 |
| 95 | 219–402 |
| 96 | 26–315 |
| 97 | 348–460 |
| 98 | 1–230 |
| 99 | 391–467 |
| 1o1 | 214–336 |
| 102 | 1–289 |
| 103 | 1–383 |
| 104 | 1–211 |
| 105 | 1–36 |
| 106 | 1–126 |
| 107 | 1–49 |
| 108 | 294–336 |
| 109 | 1–128 |
| 111 | 1–154 |
| 112 | 407–441 |
| 113 | 1–80, 139–184 |
| 114 | 10–79 |

TABLE III-continued

| SEQ ID NO | Positions of preferred fragments |
|---|---|
| 116 | 1–292 |
| 117 | 1–304 |
| 119 | 1–288 |
| 120 | 2–348 |
| 121 | 1–122 |
| 123 | 188–353 |
| 124 | 1–249 |
| 125 | 295–375 |
| 128 | 1–244 |
| 129 | 1–232 |
| 130 | 196–312 |
| 131 | 178–276 |
| 132 | 37–174 |
| 133 | 1–344 |
| 134 | 1–244 |
| 135 | 1–217 |
| 136 | 82–428 |
| 137 | 1–29, 103–155, 274–434 |
| 138 | 1–395 |
| 139 | 1–268 |
| 140 | 1–170 |
| 141 | 1–396 |
| 142 | 1–73, 227–357 |
| 143 | 1–159 |
| 144 | 1–433 |
| 145 | 61–116 |
| 146 | 1–71, 179–205 |
| 147 | 177–300 |
| 149 | 1–146 |
| 151 | 1–166 |
| 152 | 1–382 |
| 153 | 1–208 |
| 154 | 121–251 |
| 155 | 1–147 |
| 157 | 1–115 |
| 158 | 1–175 |
| 159 | 1–44, 80–230 |
| 160 | 1–346 |
| 161 | 1–277 |
| 162 | 1–235 |
| 163 | 1–34 |
| 164 | 1–195 |
| 165 | 19–78, 175–217 |
| 166 | 1–209 |
| 167 | 1–65 |
| 168 | 128–218 |
| 169 | 49–245 |
| 170 | 179–280 |
| 171 | 1–103 |
| 172 | 1–218 |
| 173 | 1–380 |
| 174 | 1–139 |
| 175 | 1–122 |
| 176 | 1–300 |
| 177 | 1–466 |
| 179 | 1–86 |
| 180 | 1–245 |
| 181 | 1–241 |
| 182 | 1–263 |
| 183 | 1–170 |
| 184 | 58–106, 399–443 |
| 185 | 1–427 |
| 186 | 1–365 |
| 187 | 1–260 |
| 188 | 1–172 |
| 189 | 1–150 |
| 190 | 161–271, 301–339 |
| 191 | 1–91 |
| 192 | 1–264 |
| 193 | 1–246 |
| 194 | 1–150 |
| 195 | 1–209 |
| 196 | 1–363 |
| 197 | 1–155 |
| 198 | 1–135 |
| 200 | 1–125 |

TABLE III-continued

| SEQ ID NO | Positions of preferred fragments |
|---|---|
| 201 | 1–210 |
| 202 | 1–338 |
| 203 | 1–188 |
| 204 | 228–347 |
| 205 | 1–440 |
| 206 | 56–221 |
| 208 | 1–422 |
| 209 | 169–195 |
| 210 | 1–363 |
| 211 | 1–368 |
| 212 | 1–448 |
| 213 | 1–134 |
| 214 | 1–193 |
| 215 | 1–214 |
| 216 | 1–134 |
| 218 | 1–189 |
| 219 | 1–248 |
| 220 | 1–115 |
| 221 | 1–113 |
| 222 | 1–370 |
| 224 | 1–251 |
| 225 | 1–198 |
| 226 | 45–141 |
| 227 | 1–206 |
| 228 | 1–480 |
| 229 | 1–144 |
| 230 | 1–42, 281–351, 432–457 |
| 231 | 1–112 |
| 233 | 1–301 |
| 234 | 1–109 |
| 235 | 1–393 |
| 236 | 1–222 |
| 237 | 1–154 |
| 238 | 1–439 |
| 239 | 112–137 |
| 240 | 1–194 |
| 241 | 1–44 |
| 242 | 1–242 |
| 244 | 1–324 |
| 245 | 1–38, 217–280 |
| 246 | 1–60 |
| 247 | 77–359 |
| 248 | 1–236 |
| 249 | 1–342 |
| 250 | 80–382 |
| 251 | 1–303 |
| 252 | 62–259 |
| 253 | 1–165 |
| 254 | 1–328 |
| 255 | 1–320 |
| 256 | 1–305 |
| 257 | 1–181 |
| 258 | 116–174 |
| 259 | 1–265 |
| 260 | 1–272 |
| 261 | 1–62 |
| 263 | 1–371 |
| 266 | 1–274 |
| 267 | 1–342 |
| 268 | 364–427 |
| 269 | 31–143 |
| 270 | 1–79 |
| 271 | 1–121 |
| 272 | 229–292 |
| 273 | 1–158 |
| 274 | 1–113 |
| 275 | 1–254 |
| 276 | 1–333 |
| 277 | 1–130 |
| 278 | 1–184 |
| 279 | 1–265 |
| 280 | 1–188 |
| 281 | 1–177 |
| 282 | 1–336 |
| 283 | 1–294 |
| 284 | 1–171 |
| 285 | 1–297 |
| 288 | 1–42 |
| 290 | 1–170 |
| 292 | 20–155 |
| 294 | 1–334 |
| 295 | 1–375 |
| 296 | 1–226 |
| 297 | 1–232 |
| 299 | 40–139 |
| 300 | 1–285 |
| 301 | 1–242 |
| 302 | 1–136 |
| 303 | 1–175 |
| 304 | 1–493 |
| 305 | 1–214 |
| 306 | 89–458 |
| 307 | 1–328 |
| 308 | 1–380 |
| 309 | 1–236 |
| 310 | 1–357 |
| 311 | 1–470 |
| 312 | 1–187 |
| 313 | 1–159 |
| 315 | 1–162 |
| 316 | 1–404 |
| 317 | 1–450 |
| 318 | 1–395 |
| 319 | 1–257 |
| 320 | 56–325 |
| 321 | 1–201 |
| 322 | 1–159 |
| 323 | 1–420 |
| 324 | 1–210 |
| 325 | 1–192 |
| 326 | 88–181 |
| 327 | 1–185 |
| 328 | 128–210 |
| 330 | 1–223 |
| 331 | 1–362 |
| 332 | 1–89 |
| 334 | 1–188 |
| 335 | 1–115 |
| 336 | 1–300 |
| 337 | 1–307 |
| 338 | 1–123 |
| 339 | 1–297 |
| 340 | 1–34 |
| 341 | 1–44 |
| 342 | 1–37 |
| 343 | 141–169 |
| 344 | 1–112 |
| 345 | 1–235, 266–349 |
| 346 | 1–191 |
| 347 | 1–229 |
| 348 | 1–210 |
| 350 | 139–266 |
| 351 | 1–307 |
| 352 | 1–170 |
| 353 | 1–293 |
| 354 | 30–161, 192–331 |
| 355 | 1–93 |
| 356 | 1–178 |
| 357 | 1–107 |
| 358 | 1–29, 168–209 |
| 359 | 1–298 |
| 360 | 1–193 |
| 362 | 1–360 |
| 363 | 1–45, 100–212 |
| 364 | 39–170, 202–242 |
| 365 | 1–248 |
| 366 | 1–351 |
| 367 | 1–208 |
| 368 | 228–446 |
| 369 | 1–62 |
| 370 | 1–132 |
| 371 | 1–127 |

TABLE III-continued

| SEQ ID NO | Positions of preferred fragments |
|---|---|
| 372 | 1–196 |
| 373 | 1–148 |
| 374 | 1–126 |
| 375 | 1–112 |
| 376 | 1–146 |
| 378 | 1–143 |
| 379 | 1–261 |
| 380 | 202–228 |
| 382 | 1–151 |
| 383 | 1–45 |
| 384 | 1–190, 250–456 |
| 385 | 1–55, 141–181 |
| 386 | 1–281 |
| 387 | 1–111 |
| 388 | 1–374 |
| 389 | 1–192 |
| 390 | 1–371 |
| 392 | 1–303 |
| 394 | 1–126 |
| 395 | 1–329 |
| 396 | 1–99 |
| 397 | 1–316 |
| 398 | 1–251 |
| 399 | 1–120 |
| 401 | 1–206 |
| 402 | 1–330 |
| 403 | 1–311 |
| 405 | 1–153 |
| 406 | 1–206 |
| 407 | 1–479 |
| 408 | 1–289 |
| 410 | 229–321 |
| 413 | 1–158 |
| 415 | 95–229 |
| 416 | 1–265 |
| 417 | 1–228 |
| 418 | 1–225 |
| 419 | 207–293 |
| 420 | 1–194 |
| 421 | 1–90 |
| 422 | 1–161 |
| 423 | 1–420 |
| 424 | 1–432 |
| 425 | 1–276, 309–419 |
| 426 | 1–232 |
| 427 | 1–81 |
| 428 | 1–96 |
| 429 | 1–165 |
| 431 | 1–58, 186–237, 327–354 |
| 433 | 1–65 |
| 434 | 1–83 |
| 435 | 1–386 |
| 436 | 405–447 |
| 438 | 1–106 |
| 439 | 45–105, 168–255, 284–447 |
| 441 | 1–409 |
| 442 | 1–320 |
| 443 | 1–256 |
| 444 | 1–284 |
| 445 | 1–240 |
| 446 | 1–149 |
| 447 | 1–360 |
| 448 | 1–123 |
| 449 | 1–94 |
| 450 | 1–302 |
| 452 | 1–349 |
| 453 | 1–270 |
| 454 | 1–492 |
| 455 | 17–105 |
| 456 | 1–102 |
| 457 | 1–108 |
| 458 | 1–285 |
| 459 | 1–311 |
| 460 | 1–191 |
| 461 | 312–420 |
| 462 | 1–257 |
| 463 | 1–117 |
| 464 | 1–142 |
| 466 | 1–235 |
| 467 | 1–29 |
| 468 | 1–41 |
| 469 | 1–438 |
| 470 | 1–131 |
| 471 | 1–211 |
| 472 | 1–150 |
| 473 | 1–352 |
| 474 | 1–141 |
| 476 | 1–232 |
| 478 | 1–201 |
| 479 | 1–151 |
| 480 | 1–104 |
| 481 | 7–429 |
| 482 | 1–385 |
| 486 | 1–226 |
| 488 | 1–296 |
| 489 | 1–72, 323–377 |
| 491 | 1–348 |
| 492 | 33–126 |
| 493 | 1–300 |
| 494 | 1–295 |
| 495 | 1–244 |
| 496 | 1–215 |
| 497 | 1–255 |
| 499 | 1–174, 384–474 |
| 500 | 1–50, 102–241 |
| 501 | 153–430 |
| 502 | 91–132 |
| 503 | 1–64 |
| 504 | 21–63, 356–420 |
| 505 | 37–68, 187–234 |
| 506 | 1–315 |
| 507 | 101–208 |
| 510 | 1–402 |
| 5I1 | 1–343 |
| 512 | 1–140, 170–246, 276–420 |
| 513 | 1–324 |
| 514 | 1–303 |
| 515 | 13–340 |
| 516 | 1–263, 293–360 |
| 518 | 1–245 |
| 519 | 111–275 |
| 520 | 62–182 |
| 521 | 1–218 |
| 523 | 1–502 |
| 524 | 1–118 |
| 525 | 1–276 |
| 526 | 223–366 |
| 527 | 1–428 |
| 528 | 297–342 |
| 529 | 1–244 |
| 530 | 1–88, 375–434 |
| 531 | 1–406 |
| 533 | 1–149 |
| 534 | 1–145 |
| 535 | 1–116 |
| 536 | 1–207 |
| 537 | 1–394 |
| 538 | 1–415 |
| 539 | 1–160 |
| 540 | 1–327 |
| 541 | 1–38, 73–396 |
| 542 | 1–247 |
| 543 | 1–221 |
| 544 | 1–375 |
| 545 | 1–376 |
| 546 | 1–109 |
| 547 | 1–160, 223–306 |
| 548 | 1–148 |
| 551 | 1–231 |
| 552 | 1–229 |
| 553 | 1–232 |
| 554 | 1–141 |

TABLE III-continued

| SEQ ID NO | Positions of preferred fragments |
|---|---|
| 555 | 1–376 |
| 556 | 1–279 |
| 557 | 1–340 |
| 558 | 1–51 |
| 559 | 1–354 |
| 562 | 1–188 |
| 563 | 1–229 |
| 564 | 184–352 |
| 566 | 308–341 |
| 567 | 1–218 |
| 568 | 1–79 |
| 569 | 1–142 |
| 570 | 1–207 |
| 571 | 1–373 |
| 572 | 1–195 |
| 573 | 1–352 |
| 574 | 1–121 |
| 575 | 1–222 |
| 576 | 151–288 |
| 577 | 1–264 |
| 578 | 1–205 |
| 580 | 1–171, 273–328 |
| 581 | 1–356 |
| 582 | 1–239 |
| 583 | 1–144 |
| 584 | 1–282 |
| 585 | 1–338 |
| 586 | 1–436 |
| 588 | 1–380 |
| 589 | 1–60 |
| 590 | 1–178 |
| 592 | 1–66 |
| 593 | 1–215 |
| 594 | 1–161 |
| 596 | 1–407 |
| 597 | 31–83 |
| 598 | 1–417 |
| 599 | 1–329 |
| 600 | 1–311 |
| 601 | 1–61, 99–214 |
| 602 | 1–154, 197–463 |
| 603 | 135–269 |
| 604 | 1–351 |
| 605 | 1–195 |
| 608 | 1–357 |
| 609 | 1–201 |
| 612 | 1–176 |
| 613 | 1–342 |
| 615 | 1–272 |
| 616 | 1–114 |
| 617 | 1–46 |
| 618 | 1–208 |
| 619 | 1–257 |
| 620 | 1–28 |
| 621 | 1–26 |
| 622 | 1–221 |
| 623 | 1–432 |
| 624 | 1–233 |
| 625 | 1–26 |
| 627 | 1–43 |
| 628 | 1–318 |
| 629 | 1–170 |
| 630 | 1–196 |
| 631 | 248–339 |
| 632 | 1–433 |
| 633 | 1–154 |
| 634 | 1–41 |
| 635 | 1–137 |
| 636 | 1–172 |
| 637 | 1–253 |
| 638 | 1–185 |
| 639 | 1–206 |
| 641 | 334–483 |
| 642 | 1–309 |
| 643 | 1–75, 162–213 |
| 644 | 107–211 |
| 645 | 1–98 |
| 646 | 1–347 |
| 647 | 1–49, 81–143 |
| 648 | 1–232 |
| 649 | 74–133 |
| 650 | 1–37 |
| 651 | 1–276 |
| 652 | 1–170 |
| 653 | 1–178 |
| 654 | 1–121 |
| 656 | 1–197 |
| 657 | 1–246 |
| 659 | 1–197 |
| 660 | 116–172 |
| 661 | 1–411 |
| 662 | 1–146 |
| 663 | 1–65 |
| 664 | 1–182 |
| 665 | 1–320 |
| 666 | 1–273 |
| 667 | 1–149 |
| 668 | 1–122 |
| 670 | 1–160 |
| 671 | 1–137 |
| 673 | 1–263 |
| 674 | 1–263 |
| 675 | 1–107 |
| 677 | 1–441 |
| 678 | 134–191 |
| 679 | 1–235 |
| 680 | 1–26 |
| 682 | 1–58, 269–328 |
| 683 | 1–447 |
| 684 | 1–217 |
| 685 | 1–132 |
| 686 | 1–60 |
| 688 | 1–107 |
| 689 | 132–221, 327–377 |
| 690 | 1–388 |
| 691 | 1–141, 171–408 |
| 692 | 1–322 |
| 693 | 1–153 |
| 695 | 1–455 |
| 698 | 1–58, 117–174 |
| 699 | 240–300 |
| 700 | 1–159 |
| 701 | 1–69 |
| 702 | 1–175 |
| 703 | 1–298 |
| 704 | 1–136 |
| 705 | 1–168 |
| 706 | 1–419 |
| 707 | 1–382 |
| 708 | 8–245, 296–384 |
| 709 | 1–149 |
| 710 | 1–167 |
| 711 | 1–35 |
| 712 | 1–80, 116–156, 206–241 |
| 713 | 33–376 |
| 714 | 1–304 |
| 715 | 1–242 |
| 717 | 1–145 |
| 718 | 1–350 |
| 720 | 1–257 |
| 721 | 1–360 |
| 722 | 1–191 |
| 724 | 1–139 |
| 726 | 1–207 |
| 727 | 99–164 |
| 728 | 1–321 |
| 730 | 156–372 |
| 731 | 1–109, 256–290 |
| 735 | 25–192 |
| 737 | 1–160 |
| 738 | 1–227 |
| 739 | 441–514 |

TABLE III-continued

| SEQ ID NO | Positions of preferred fragments |
|---|---|
| 742 | 217–280 |
| 743 | 10–275 |
| 747 | 1–179 |
| 749 | 2–31, 139–168 |
| 750 | 349–410 |
| 752 | 1–119 |
| 753 | 1–121 |
| 754 | 1–28 |
| 760 | 25–175 |
| 761 | 1–212 |
| 763 | 8–75 |
| 766 | 1–59, 102–248, 295–320 |
| 769 | 53–85 |
| 771 | 1–370 |
| 774 | 1–347 |
| 776 | 1–200 |
| 778 | 39–342 |
| 779 | 4–28 |
| 780 | 1–49, 407–472 |
| 781 | 116–426 |
| 782 | 1–59 |
| 783 | 1–53, 219–453 |
| 784 | 29–53, 219–263, 426–494 |
| 785 | 99–347, 386–461 |
| 786 | 2–28 |
| 788 | 1–279 |
| 789 | 1–58 |
| 790 | 226–268 |
| 792 | 129–218 |
| 794 | 265–431 |
| 796 | 5–86 |
| 797 | 1–34 |
| 799 | 1–344 |
| 802 | 46–477 |
| 806 | 64–384 |
| 807 | 135–301 |
| 808 | 2–314 |
| 810 | 6–39 |
| 1600 | 1–25 |
| 1601 | 1–225 |
| 1602 | 23–139 |
| 1603 | 1–294 |
| 1606 | 15–44 |
| 1607 | 1–361 |
| 1611 | 85–228 |
| 1612 | 1–221 |
| 1613 | 138–281 |
| 1614 | 65–171 |
| 1615 | 2–142 |
| 1616 | 1–46 |
| 1617 | 1–95 |
| 1620 | 1–187 |
| 1621 | 1–136 |
| 1622 | 32–280, 311–400 |

TABLE IV

| SEQ ID NO | Positions of Preferred Fragments |
|---|---|
| 35 | 1–52 |
| 41 | 1–115 |
| 45 | 1–47 |
| 46 | 1–33 |
| 66 | 400–428 |
| 82 | 83–149 |
| 93 | 399–508 |
| 105 | 1–36 |
| 114 | 1–79 |
| 120 | 1–386 |
| 121 | 1–190 |
| 124 | 1–249 |
| 125 | 295–328 |

TABLE IV-continued

| SEQ ID NO | Positions of Preferred Fragments |
|---|---|
| 139 | 1–81, 125–268 |
| 159 | 1–139, 180–230 |
| 165 | 1–78 |
| 170 | 179–205, 248–280 |
| 194 | 1–150 |
| 213 | 1–158 |
| 247 | 1–104, 155–183, 280–359 |
| 269 | 31–143 |
| 350 | 139–386 |
| 368 | 228–446 |
| 385 | 1–72, 143–193 |
| 415 | 95–229 |
| 435 | 1–386 |
| 436 | 446–472 |
| 441 | 1–361 |
| 454 | 1–349 |
| 455 | 1–105 |
| 459 | 35–161, 200–311 |
| 460 | 1–26, 56–140 |
| 481 | 1–429 |
| 489 | 1–84 |
| 496 | 1–44, 84–215 |
| 501 | 153–430 |
| 502 | 1–91 |
| 504 | 1–63 |
| 505 | 1–68 |
| 514 | 1–303 |
| 515 | 237–351 |
| 519 | 1–145 |
| 526 | 231–366 |
| 530 | 1–88 |
| 535 | 1–55 |
| 570 | 76–207 |
| 576 | 168–218, 261–288 |
| 588 | 1–331 |
| 597 | 1–83 |
| 627 | 1–43 |
| 634 | 1–41 |
| 641 | 1–55, 334–483 |
| 672 | 1–34 |
| 687 | 1–129 |
| 708 | 1–245, 296–384 |
| 710 | 1–26, 104–167 |
| 722 | 1–191 |
| 730 | 1–465 |
| 731 | 1–43 |
| 735 | 1–91 |
| 737 | 1–160 |
| 738 | 1–186 |
| 739 | 1–48 |
| 742 | 1–62, 99–248 |
| 743 | 1–315, 412–459 |
| 744 | 1–31 |
| 747 | 1–63 |
| 749 | 1–32 |
| 750 | 1–38 |
| 752 | 1–139 |
| 753 | 1–193 |
| 754 | 1–28 |
| 759 | 1–38 |
| 760 | 1–115 |
| 763 | 1–62 |
| 765 | 1–126 |
| 769 | 1–85 |
| 770 | 1–40 |
| 771 | 1–148 |
| 774 | 1–134 |
| 775 | 265–531 |
| 776 | 71–203 |
| 777 | 333–469 |
| 778 | 144–468 |
| 779 | 1–28 |
| 780 | 1–49 |
| 781 | 1–102 |
| 782 | 1–59 |
| 783 | 1–53 |

TABLE IV-continued

| SEQ ID NO | Positions of Preferred Fragments |
|---|---|
| 784 | 1–220, 262–390 |
| 785 | 1–339, 408–461 |
| 786 | 1–28 |
| 789 | 1–58 |
| 791 | 1–126 |
| 792 | 1–31, 129–220 |
| 793 | 1–31 |
| 794 | 355–431 |
| 795 | 1–33 |
| 797 | 1–31 |
| 798 | 1–31 |
| 799 | 1–401 |
| 801 | 1–117 |
| 802 | 1–92 |
| 806 | 64–384 |
| 807 | 1–331 |
| 808 | 1–351 |
| 810 | 1–39 |
| 1600 | 1–25 |
| 1603 | 1–341 |
| 1606 | 1–31 |
| 1607 | 1–361 |
| 1608 | 164–305 |
| 1611 | 85–228 |
| 1612 | 1–221 |
| 1613 | 112–360 |
| 1614 | 1–171 |
| 1615 | 94–193 |
| 1617 | 1–155 |
| 1620 | 1–246 |

III. Evaluation of Spatial and Temporal Expression of mRNAs Corresponding to the 5'ESTs Consensus Contigated 5'ESTs, or EST-Related Nucleic Acids

EXAMPLE 17

Expression Patterns of mRNAs from which the 5' ESTs were Obtained

Each of the SEQ ID NOs. 24–811 and 1600–1622 was also categorized based on the tissue from which its corresponding mRNA was obtained, as follows.

Table V shows the spatial distribution of each nucleic acid sequence of the invention (SEQ ID NOs. 24–811 and 1600–1622) referred to by its sequence identification number in the first column. In the second column entitled tissue distribution, the spatial distribution is represented by the number of individual 5'ESTs used to assemble the consensus contigated 5'ESTs for a given tissue. Each type of tissue listed in Table V is encoded by a letter. The correspondence between the letter code and the type is given in Table VI.

TABLE V

| SEQ ID NO | Tissue Distribution |
|---|---|
| 24 | AA:1 |
| 25 | S:1 |
| 26 | P:1 |
| 27 | W:1 |
| 28 | P:1 |
| 29 | S:1 |
| 30 | P:1 |
| 31 | P:1 |
| 32 | P:1 |
| 33 | P:1 |
| 34 | AB:1 |
| 35 | G:3; P:1; S:1; W:3; AA:4 |
| 36 | P:1 |
| 37 | S:1 |
| 38 | Q:1 |
| 39 | P:1 |
| 40 | AB:1 |
| 41 | B:1; C:3; F:1; G:1; H:4; S:2; T:8; W:1; Z:1; AA:3; AC:1; AD:3 |
| 42 | A:1 |
| 43 | N:2 |
| 44 | P:1 |
| 45 | C:2; K:1; O:1; S:5 |
| 46 | K:1; S:2; AA:1 |
| 47 | AA:1 |
| 48 | C:1, O:1; P:8 |
| 49 | P:1 |
| 50 | P:1 |
| 51 | P:1 |
| 52 | S:1 |
| 53 | AA:1 |
| 54 | T:1 |
| 55 | P:1 |
| 56 | P:1 |
| 57 | P:1 |
| 58 | P:1 |
| 59 | P:7; T:2; Z:1 |
| 60 | R:1 |
| 61 | C:1 |
| 62 | P:1 |
| 63 | F:1 |
| 64 | AA:1 |
| 65 | F:1 |
| 66 | P:4; T:2; Z:1 |
| 67 | S:1 |
| 68 | AA:1 |
| 69 | P:1 |
| 70 | P:1 |
| 71 | S:1 |
| 72 | W:1 |
| 73 | G:1 |
| 74 | P:1 |
| 75 | N:1 |
| 76 | P:1 |
| 77 | S:1 |
| 78 | U:1 |
| 79 | B:1 |
| 80 | P:1 |
| 81 | AC:1 |
| 82 | K:1; O:1 |
| 83 | G:1 |
| 84 | C:1; K:2; P:29; S:2; T:1; X:2; Y:1; AA:2 |
| 85 | K:1 |
| 86 | C:1 |
| 87 | F:1 |
| 88 | AB:1 |
| 89 | H:1 |
| 90 | M:1 |
| 91 | B:1 |
| 92 | K:1 |
| 93 | AC:2 |
| 94 | P:1 |
| 95 | M:1 |
| 96 | Z:2 |
| 97 | K:1; P:11; S:1; X:1; AA:1 |
| 98 | W:1 |
| 99 | X:1 |
| 100 | P:1 |
| 101 | AB:1 |
| 102 | F:1 |
| 103 | AA:1 |
| 104 | K:1 |
| 105 | B:4; C:6; E:2; H:3; O:2; Q:1; S:3; AC:2 |
| 106 | T:1 |
| 107 | O:1 |
| 108 | P:1 |
| 109 | G:1 |

TABLE V-continued

| SEQ ID NO | Tissue Distribution |
|---|---|
| 110 | AA:1 |
| 111 | T:1 |
| 112 | P:1 |
| 113 | F:1 |
| 114 | B:3; C:4; K:5; S:4; Y:1 |
| 115 | U:1 |
| 116 | W:1 |
| 117 | T:1 |
| 118 | T:2 |
| 119 | T:1 |
| 120 | H:3 |
| 121 | AA:3 |
| 122 | K:1 |
| 123 | H:2 |
| 124 | AA:2 |
| 125 | B:1; G:1; J:3; T:13; Y:5; AA:5; AD:2 |
| 126 | H:1; P:1 |
| 127 | K:1 |
| 128 | F:1 |
| 129 | G:1 |
| 130 | P:1 |
| 131 | B:1 |
| 132 | AA:1 |
| 133 | W:1 |
| 134 | P:1 |
| 135 | K:1 |
| 136 | B:1; C:1 |
| 137 | B:1 |
| 138 | H:1 |
| 139 | AC:2 |
| 140 | T:1 |
| 141 | B:1 |
| 142 | H:1 |
| 143 | T:1 |
| 144 | H:1 |
| 145 | B:1 |
| 146 | R:1 |
| 147 | P:1 |
| 148 | C:1; H:2; O:1; S:2; T:1; AC:2 |
| 149 | H:1 |
| 150 | AA:1 |
| 151 | W:1 |
| 152 | S:1 |
| 153 | F:1 |
| 154 | M:1 |
| 155 | B:1 |
| 156 | R:1 |
| 157 | W:1 |
| 158 | T:1 |
| 159 | C:1; AA:1 |
| 160 | F:1 |
| 161 | H:1 |
| 162 | D:1 |
| 163 | AA:1 |
| 164 | AA:1 |
| 165 | W:3 |
| 166 | AA:1 |
| 167 | W:1 |
| 168 | F:1 |
| 169 | B:1 |
| 170 | G:2 |
| 171 | E:1 |
| 172 | B:1 |
| 173 | F:1 |
| 174 | B:1 |
| 175 | W:1 |
| 176 | K:1 |
| 177 | AA:1 |
| 178 | S:1 |
| 179 | K:1 |
| 180 | AA:1 |
| 181 | W:1 |
| 182 | K:1 |
| 183 | T:1 |
| 184 | P:1 |
| 185 | B:1 |
| 186 | W:1 |
| 187 | R:1 |
| 188 | T:1 |
| 189 | T:1 |
| 190 | W:1 |
| 191 | A:1 |
| 192 | F:1 |
| 193 | B:1 |
| 194 | G:3 |
| 195 | W:1 |
| 196 | O:1 |
| 197 | T:1 |
| 198 | O:1 |
| 199 | B:1 |
| 200 | AA:1 |
| 201 | G:1 |
| 202 | B:1 |
| 203 | G:1 |
| 204 | P:1 |
| 205 | AA:1 |
| 206 | Y:1 |
| 207 | Y:1 |
| 208 | AA:1 |
| 209 | G:1 |
| 210 | H:1 |
| 211 | C:1 |
| 212 | H:1 |
| 213 | W:2 |
| 214 | Y:1 |
| 215 | AB:1 |
| 216 | K:1 |
| 217 | M:1 |
| 218 | AD:1 |
| 219 | A:1 |
| 220 | AA:1 |
| 221 | G:1 |
| 222 | G:1 |
| 223 | G:1; H:2; S:2; X:1 |
| 224 | G:1 |
| 225 | G:1 |
| 226 | B:1 |
| 227 | P:1 |
| 228 | O:1 |
| 229 | G:1 |
| 230 | T:1 |
| 231 | T:1 |
| 232 | K:1 |
| 233 | S:1 |
| 234 | O:1 |
| 235 | F:1 |
| 236 | T:1 |
| 237 | B:1 |
| 238 | W:1 |
| 239 | G:1 |
| 240 | R:1 |
| 241 | A:1 |
| 242 | W:1 |
| 243 | P:1 |
| 244 | H:1 |
| 245 | D:1 |
| 246 | C:1 |
| 247 | B:2 |
| 248 | P:1 |
| 249 | F:1 |
| 250 | AB:1 |
| 251 | W:1 |
| 252 | H:1 |
| 253 | B:1 |
| 254 | S:1 |
| 255 | T:1 |
| 256 | W:1 |
| 257 | T:1 |
| 258 | AA:2 |
| 259 | P:1 |
| 260 | W:1 |
| 261 | H:1 |

TABLE V-continued

| SEQ ID NO | Tissue Distribution |
|---|---|
| 262 | K:1 |
| 263 | K:1 |
| 264 | C:1; E:1; F:1; I:4; L:1; N:22; O:1; P:1; S:1; T:9; AA:1 |
| 265 | A:1 |
| 266 | T:1 |
| 267 | K:1 |
| 268 | H:1 |
| 269 | T:2 |
| 270 | T:1 |
| 271 | T:1 |
| 272 | B:1 |
| 273 | Y:1 |
| 274 | T:1 |
| 275 | G:1 |
| 276 | AA:1 |
| 277 | T:1 |
| 278 | AB:1 |
| 279 | T:1 |
| 280 | W:1 |
| 281 | F:1 |
| 282 | K:1 |
| 283 | H:1 |
| 284 | O:1 |
| 285 | W:1 |
| 286 | B:21; C:7; H:5; K:5; O:8; S:16; W:1; Y:3; Z:4; AA:2; AC:1 |
| 287 | K:2; P:12; W:1; AC:2 |
| 288 | S:1 |
| 289 | K:2; P:8; W:1; AC:2 |
| 290 | S:1 |
| 291 | H:1 |
| 292 | B:11; C:2; E:1; H:7; K:1; N:3; S:1; T:8; W:1; AA:28; AC:1 |
| 293 | B:6; C:3; G:1; H:6; K:4; N:4; O:3; Q:2; S:5; T:1; U:1; V:2; Y:3; AA:1 |
| 294 | B:1 |
| 295 | H:1 |
| 296 | AA:1 |
| 297 | T:1 |
| 298 | T:1 |
| 299 | T:1 |
| 300 | H:1; S:1 |
| 301 | H:1 |
| 302 | W:1 |
| 303 | W:1 |
| 304 | H:1 |
| 305 | G:1 |
| 306 | K:1 |
| 307 | H:1 |
| 308 | A:1 |
| 309 | H:1 |
| 310 | H:1 |
| 311 | Y:1 |
| 312 | G:1 |
| 313 | H:1 |
| 314 | K:1 |
| 315 | Y:1 |
| 316 | P:1 |
| 317 | H:1 |
| 318 | AA:1 |
| 319 | H:1 |
| 320 | O:1 |
| 321 | Y:1 |
| 322 | B:1 |
| 323 | P:1 |
| 324 | P:1 |
| 325 | K:1 |
| 326 | H:1 |
| 327 | H:1 |
| 328 | Q:1 |
| 329 | S:1 |
| 330 | B:1 |
| 331 | T:1 |
| 332 | T:1 |
| 333 | B:1 |
| 334 | T:1 |
| 335 | W:1 |
| 336 | P:1 |
| 337 | A:1 |
| 338 | AA:1 |
| 339 | AA:1 |
| 340 | G:1 |
| 341 | C:1 |
| 342 | K:1 |
| 343 | S:1 |
| 344 | G:1 |
| 345 | B:1 |
| 346 | Y:1 |
| 347 | G:1 |
| 348 | F:1 |
| 349 | AA:5 |
| 350 | B:15; C:1; G:1; H:1; O:1; Q:2; S:1; X:1; Y:1 |
| 351 | F:1 |
| 352 | R:1 |
| 353 | O:1 |
| 354 | H:1 |
| 355 | W:1 |
| 356 | F:1 |
| 357 | T:1 |
| 358 | S:1 |
| 359 | X:1 |
| 360 | T:1 |
| 361 | K:1 |
| 362 | K:1 |
| 363 | G:1 |
| 364 | K:1 |
| 365 | G:1 |
| 366 | AA:1 |
| 367 | F:1 |
| 368 | C:2; H:2; X:1 |
| 369 | E:1 |
| 370 | T:1 |
| 371 | H:1 |
| 372 | G:1 |
| 373 | AA:1 |
| 374 | G:1 |
| 375 | F:1 |
| 376 | F:1 |
| 377 | R:1 |
| 378 | AA:1 |
| 379 | AA:1 |
| 380 | C:1 |
| 381 | H:1 |
| 382 | T:1 |
| 383 | W:1 |
| 384 | S:1 |
| 385 | AA:2 |
| 386 | D:1 |
| 387 | O:1 |
| 388 | W:1 |
| 389 | F:1 |
| 390 | W:1 |
| 391 | K:1 |
| 392 | W:1 |
| 393 | K:1 |
| 394 | T:1 |
| 395 | H:1 |
| 396 | T:1 |
| 397 | T:1 |
| 398 | G:1 |
| 399 | C:1 |
| 400 | K:1 |
| 401 | B:1 |
| 402 | H:1 |
| 403 | B:1 |
| 404 | B:1 |
| 405 | H:1 |
| 406 | AB:1 |
| 407 | O:1 |
| 408 | P:1 |
| 409 | X:1 |
| 410 | H:1 |
| 411 | B:9; C:3; K:3; L:2; O:1; S:2; X:1; AA:1 |
| 412 | G:1; S:2; V:2; W:1; Y:1; Z:1 |

TABLE V-continued

| SEQ ID NO | Tissue Distribution |
|---|---|
| 413 | W:1 |
| 414 | G:1 |
| 415 | B:3; C:3; F:1; G:2; H:4; J:1; K:1; O:1; P:3; S:1; V:1 |
| 416 | I:1 |
| 417 | F:1 |
| 418 | F:1 |
| 419 | F:1 |
| 420 | AA:1 |
| 421 | F:1 |
| 422 | T:1 |
| 423 | P:1 |
| 424 | B:1 |
| 425 | Y:1 |
| 426 | W:1 |
| 427 | AA:1 |
| 428 | W:1 |
| 429 | H:1 |
| 430 | Y:1 |
| 431 | J:1 |
| 432 | AA:1 |
| 433 | G:1 |
| 434 | AA:1 |
| 435 | B:3; H:1 |
| 436 | B:9; G:4; H:8; K:2; O:2; W:1; Z:2; AA:2; AD:3 |
| 437 | H:1; T:1 |
| 438 | T:1 |
| 439 | R:1 |
| 440 | M:1 |
| 441 | H:2 |
| 442 | W:1 |
| 443 | B:1 |
| 444 | W:1 |
| 445 | AB:1 |
| 446 | F:1 |
| 447 | AD:1 |
| 448 | AB:1 |
| 449 | N:1 |
| 450 | T:1 |
| 451 | W:1 |
| 452 | O:1 |
| 453 | AA:1 |
| 454 | D:28 |
| 455 | W:1 |
| 456 | T:1 |
| 457 | G:1 |
| 458 | W:1 |
| 459 | Y:4 |
| 460 | B:3 |
| 461 | P:2 |
| 462 | K:1 |
| 463 | T:1 |
| 464 | H:1 |
| 465 | G:1 |
| 466 | AC:1 |
| 467 | R:1 |
| 468 | S:1 |
| 469 | B:1 |
| 470 | S:1 |
| 471 | T:1 |
| 472 | AA:1 |
| 473 | W:1 |
| 474 | T:1 |
| 475 | S:1 |
| 476 | T:1 |
| 477 | AA:1 |
| 478 | G:1 |
| 479 | W:1 |
| 480 | B:1 |
| 481 | O:2 |
| 482 | K:1 |
| 483 | P:1 |
| 484 | W:1 |
| 485 | P:1 |
| 486 | B:1 |
| 487 | Y:1 |
| 488 | H:1 |
| 489 | P:1; Q:1; S:3 |
| 490 | C:1 |
| 491 | S:1 |
| 492 | H:1 |
| 493 | B:1 |
| 494 | H:1 |
| 495 | G:1 |
| 496 | N:2 |
| 497 | B:1 |
| 498 | G:1 |
| 499 | P:1 |
| 500 | G:1 |
| 501 | C:1; K:1; Q:1 |
| 502 | B:4 |
| 503 | R:1 |
| 504 | B:5; H:2; W:2 |
| 505 | G:2; H:1 |
| 506 | W:1 |
| 507 | B:1 |
| 508 | W:1 |
| 509 | AB:1 |
| 510 | H:1 |
| 511 | N:1 |
| 512 | J:1 |
| 513 | AA:1 |
| 514 | T:2 |
| 515 | AA:5 |
| 516 | F:1 |
| 517 | C:1; O:1 |
| 518 | W:1 |
| 519 | T:4 |
| 520 | B:1 |
| 521 | H:1 |
| 522 | H:2; T:3 |
| 523 | H:1 |
| 524 | AA:1 |
| 525 | W:1 |
| 526 | C:2; E:1; J:1; R:3; S:4; AA:1 |
| 527 | H:1 |
| 528 | S:1 |
| 529 | P:1 |
| 530 | B:1; H:1 |
| 531 | O:1 |
| 532 | Y:1 |
| 533 | H:1 |
| 534 | T:1 |
| 535 | T:2 |
| 536 | B:1 |
| 537 | AD:1 |
| 538 | AA:1 |
| 539 | T:1 |
| 540 | F:1 |
| 541 | AD:1 |
| 542 | W:1 |
| 543 | W:1 |
| 544 | F:1 |
| 545 | T:1 |
| 546 | F:1 |
| 547 | K:1 |
| 548 | Y:1 |
| 549 | S:1 |
| 550 | B:1 |
| 551 | B:1 |
| 552 | B:1 |
| 553 | H:1 |
| 554 | P:1 |
| 555 | G:1 |
| 556 | H:1 |
| 557 | K:1 |
| 558 | B:1 |
| 559 | R:1 |
| 560 | AB:1 |
| 561 | C:1; S:1; V:1 |
| 562 | AA:1 |
| 563 | K:1 |
| 564 | P:1 |

TABLE V-continued

| SEQ ID NO | Tissue Distribution |
|---|---|
| 565 | K:1 |
| 566 | G:1 |
| 567 | W:1 |
| 568 | E:1; W:2 |
| 569 | W:1 |
| 570 | B:2 |
| 571 | O:1 |
| 572 | T:1 |
| 573 | B:1 |
| 574 | T:1 |
| 575 | B:1 |
| 576 | B:3 |
| 577 | B:1 |
| 578 | X:1 |
| 579 | H:1 |
| 580 | AA:1 |
| 581 | AA:1 |
| 582 | AA:1 |
| 583 | AA:1 |
| 584 | AA:1 |
| 585 | D:1 |
| 586 | H:1 |
| 587 | H:1 |
| 588 | AA:3 |
| 589 | K:1 |
| 590 | W:1 |
| 591 | K:1 |
| 592 | W:1 |
| 593 | B:1 |
| 594 | V:1 |
| 595 | R:1 |
| 596 | P:1 |
| 597 | G:1; X:2; Z:1 |
| 598 | X:1 |
| 599 | F:1 |
| 600 | F:1 |
| 601 | Y:1 |
| 602 | F:1 |
| 603 | W:1 |
| 604 | H:1 |
| 605 | G:1 |
| 606 | C:2; H:1; S:3; W:2; AD:3 |
| 607 | W:1 |
| 608 | C:1 |
| 609 | F:1 |
| 610 | K:1 |
| 611 | M:1 |
| 612 | AD:1 |
| 613 | H:1 |
| 614 | T:1 |
| 615 | H:1 |
| 616 | F:1 |
| 617 | T:1 |
| 618 | G:1 |
| 619 | G:1 |
| 620 | B:1 |
| 621 | W:1 |
| 622 | W:1 |
| 623 | T:1 |
| 624 | AA:1 |
| 625 | G:1 |
| 626 | M:1 |
| 627 | C:2; T:2; W:1; Y:1 |
| 628 | T:1 |
| 629 | J:1 |
| 630 | T:1 |
| 631 | P:1 |
| 632 | H:1 |
| 633 | H:1 |
| 634 | C:1; S:1; T:1; AD:1 |
| 635 | J:1 |
| 636 | G:1 |
| 637 | W:1 |
| 638 | AA:1 |
| 639 | W:1 |
| 640 | B:6; C:3; G:1; H:2; K:6; O:4; Q:1; R:2; S:1; T:3; Y:3; Z:2; AA:2; AC:2; AD:3 |
| 641 | B:21; C,2, G:5; W:4; Y:1 |
| 642 | AA:1 |
| 643 | P:1 |
| 644 | AA:1 |
| 645 | T:1 |
| 646 | K:1 |
| 647 | F:1 |
| 648 | F:1 |
| 649 | F:1 |
| 650 | T:1 |
| 651 | W:1 |
| 652 | T:1 |
| 653 | T:1 |
| 654 | P:1 |
| 655 | B:1; H:2; N:1; T:3; Y:1 |
| 656 | B:1 |
| 657 | T:1 |
| 658 | R:1 |
| 659 | K:1 |
| 660 | W:1 |
| 661 | AA:1 |
| 662 | Y:1 |
| 663 | W:1 |
| 664 | G:1 |
| 665 | S:1 |
| 666 | Y:1 |
| 667 | F:1 |
| 668 | T:1 |
| 669 | B:1 |
| 670 | F:1 |
| 671 | T:1 |
| 672 | A:2; B:6; C:1; G:1; H:3; J:1; L:1; P:2; Q:1; S:4; T:1; V:3; W:2; Y:1; AA:3; AD:2 |
| 673 | T:1 |
| 674 | G:1 |
| 675 | F:1 |
| 676 | M:1 |
| 677 | G:1 |
| 678 | Y:1 |
| 679 | D:1 |
| 680 | P:1 |
| 681 | D:1 |
| 682 | AA:1 |
| 683 | G:1 |
| 684 | K:1 |
| 685 | G:1 |
| 686 | P:1 |
| 687 | B:3; C:2; D:2; E:2; J:4; V:2; AC:6 |
| 688 | AA:1 |
| 689 | S:1 |
| 690 | AA:1 |
| 691 | H:1 |
| 692 | AA:1 |
| 693 | S:1 |
| 694 | AB:1 |
| 695 | T:1 |
| 696 | H:1 |
| 697 | B:4; E:1; F:1; P:1; T:2; Z:2 |
| 698 | O:1 |
| 699 | W:1 |
| 700 | S:1 |
| 701 | O:1 |
| 702 | B:1 |
| 703 | AB:1 |
| 704 | H:1 |
| 705 | B:1 |
| 706 | H:1 |
| 707 | G:1 |
| 708 | F:1; H:1; K:1; W:2; AA:1 |
| 709 | H:1 |
| 710 | T:2 |
| 711 | C:1 |
| 712 | G:1 |
| 713 | Y:1 |

TABLE V-continued

| SEQ ID NO | Tissue Distribution |
|---|---|
| 714 | C:1 |
| 715 | Y:1 |
| 716 | Z:1 |
| 717 | P:1 |
| 718 | G:1 |
| 719 | S:1 |
| 720 | K:1 |
| 721 | M:1 |
| 722 | T:2 |
| 723 | O:1; P:2; S:2 |
| 724 | T:1 |
| 725 | T:1 |
| 726 | N:1 |
| 727 | T:1 |
| 728 | T:1 |
| 729 | C:2; H:2; K:2; V:1; AC:1 |
| 730 | B:7; H:2; Y:1 |
| 731 | B:5; W:3 |
| 732 | B:1; C:2; G:2; S:2; AA:9 |
| 733 | B:6; C:2; G:1; H:10; O:2; P:6; Q:1; S:2; W:4; AC:2 |
| 734 | B:6; O:1; V:1 |
| 735 | C:1; O:2 |
| 736 | B:1; H:2; N:1; T:3; Y:1 |
| 737 | T:2 |
| 738 | T:2 |
| 739 | B:3; C:8; D:1; E:6; G:3; H:11; I:1; J:1; N:1; O:3; P:12; Q:3; S:2; T:2; W:1; AC:1; AD:8 |
| 740 | H:2; Y:1 |
| 741 | C:2; H:1 |
| 742 | B:12; C:1; G:1; H:4; K:2; O:2; S:4; T:2; Y:2 |
| 743 | AA:4 |
| 744 | B:1; G:1; H:6; T:1; W:1 |
| 745 | C:7; E:1; G:3; H:2; P:2; S:2; T:1; W:1; AD:2 |
| 746 | G:2; S:1 |
| 747 | T:2 |
| 748 | S:3 |
| 749 | H:1; O:2; S:2 |
| 750 | Y:1; AD:1 |
| 751 | B:8; G:2; H:2; I:1; Q:2; S:2; T:1; W:2 |
| 752 | T:3 |
| 753 | P:4 |
| 754 | B:1; H:2 |
| 755 | B:7; C:1; G:6; H:2; K:1; U:2; V:1; Z:1 |
| 756 | C:1; H:1; J:2; O:2; S:1; T:2; W:1; AA:1 |
| 757 | B:1; C:1; K:3; S:1; V:1; Y:1 |
| 758 | E:1; H:2; K:1; P:1; Q:1; AD:5 |
| 759 | B:6; C:1; Y:1 |
| 760 | B:4 |
| 761 | W:2 |
| 762 | B:3; C:7; H:9; N:1; S:1; T:1; Y:1; AA:1 |
| 763 | N:1; S:1; AA:5 |
| 764 | H:3 |
| 765 | B:3; G:1; W:1 |
| 766 | H:2 |
| 767 | C:1; AA:3 |
| 768 | B:2; C:6; H:9; N:1; S:1; T:1; Y:1; AA:1 |
| 769 | A:1; B:4; C:4; F:4; G:6; H:10; K:2; O:8; P:2; R:1; S:8; T:2; W:3; AA:2; AC:1 |
| 770 | A:2; P:16; X:1 |
| 771 | AA:3 |
| 772 | O:4 |
| 773 | B:1; C:1; W:1 |
| 774 | P:2; X:4 |
| 775 | B:18; C:6; H:5; K:3; O:7; S:10; W:1; Y:3; Z:2; AA:2; AC:1 |
| 776 | H:7 |
| 777 | B:26; C:8; H:5; K:4; O:10; S:17; W:1; Y:4; Z:4; AA:4; AC:2 |
| 778 | B:6 |
| 779 | B:3; C:1; G:1; H:2; K:1; Q:1; S:8; W:2; Y:9; AA:4 |
| 780 | B:3; C:1; F:1; P:1; W:1; AC:1 |
| 781 | I:2; N:1; P:1; R:3; AA:1 |
| 782 | B:2 |
| 783 | H:1; P:2; S:3; AD:1 |
| 784 | H:1; P:1; S:4; AD:1 |
| 785 | T:2 |
| 786 | D:1; AC:9 |
| 787 | H:1; L:1; S:1 |
| 788 | B:6; S:4 |
| 789 | S:1; T:1 |
| 790 | B:1; C:2; H:5; W:1; AD:1 |
| 791 | B:3; C:2; D:3; E:2; J:4; V:3; AC:5 |
| 792 | B:3; D:1; K:2; S:2; Y:1 |
| 793 | B:2; G:2; AA:1 |
| 794 | B:25; C:4; D:1; E:1; F:3; G:6; J:1; K:6; N:1; O:1; P:2; R:1; S:3; T:2; W:2; X:1; Y:1; Z:1; AA:1; AC:2; AD:1 |
| 795 | B:4; C:1; E:2; H:4; J:1; L:1; O:4; S:1; V:1; Y:3; Z:1 |
| 796 | H:5 |
| 797 | B:2; E:1; N:2 |
| 798 | B:1; G:1; H:6; T:1; W:1 |
| 799 | H:2 |
| 800 | H:2; I:2; AA:1 |
| 801 | A:2; B:4; C:14; D:1; H:2; K:1; N:2; S:4; T:1; W:2; AA:20 |
| 802 | AA:17 |
| 803 | B:2; G:3; H:3; S:1; U:1; AC:1; AD:2 |
| 804 | C:1; S:2; T:2; X:2; AA:1; AC:1 |
| 805 | B:5; C:6; D:5; H:17; J:2; K:4; N:1; O:6; P:2; S:5; T:5; W:1; X:1; Z:2; AA:13; AC:3 |
| 806 | B:2; C:3; D:3; H:6; J:2; K:1; N:1; O:3; P:1; S:2; T:4; W:1; X:1; Z:1; AA:5; AC:1 |
| 807 | H:1; AC:4 |
| 808 | R:13 |
| 809 | B:3; W:4 |
| 810 | B:16; S:1; Y:14 |
| 811 | B:8; C:5; G:1; H:1; K:5; O:2; Q:2; R:2; S:2; T:3; Y:4; Z:2; AA:1; AC:1; AD:2 |
| 1600 | T:4 |
| 1601 | AA:3 |
| 1602 | C:3; H:1 |
| 1603 | H:2; AC:2 |
| 1604 | B:7; C:1; E:1; H:1; P:2; R:3; S:2; T:2; Z:3; AA:2 |
| 1605 | C:4; H:3; O:1 |
| 1606 | A:3; B:13; C:14; D:2; E:10; F:3; G:19; H:32; K:11; O:5; P:2; R:3; S:16; T:4; W:2; Y:10; Z:8; AA:1; AC:3 |
| 1607 | T:3 |
| 1608 | B:3; P:2 |
| 1609 | R:4 |
| 1610 | B:4 |
| 1611 | B:3; T:1 |
| 1612 | T:2 |
| 1613 | V:5 |
| 1614 | D:3 |
| 1615 | AA:10 |
| 1616 | B:4 |
| 1617 | T:2 |
| 1618 | K:2; S:8; AA:1 |
| 1619 | B:2 |
| 1620 | W:2 |
| 1621 | H:1; AB:1 |
| 1622 | H:2 |

TABLE VI

| Tissue code | Tissue type |
|---|---|
| A | Bone Marrow |
| B | Brain |
| C | Cancerous prostate |
| D | Cerebellum |
| E | Colon |
| F | Dystrophic muscle |
| G | Fetal brain |
| H | Fetal kidney |
| I | Fetal liver |
| J | Heart |
| K | Hypertrophic prostate |
| L | Kidney |
| M | Large intestine |
| N | Liver |
| O | Lung |
| P | Lymph ganglia |

TABLE VI-continued

| Tissue code | Tissue type |
|---|---|
| Q | Lymphocytes |
| R | Muscle |
| S | Prostate |
| T | Ovary |
| U | Pancreas |
| V | Placenta |
| W | Spinal cord |
| X | Spleen |
| Y | Substantia nigra |
| Z | Surrenals |
| AA | Testis |
| AB | Thyroid |
| AC | Umbilical cord |
| AD | Uterus |

In addition to categorizing the 5' ESTs and consensus contigated 5' ESTs with respect to their tissue of origin, the spatial and temporal expression patterns of the mRNAs corresponding to the 5' ESTs and consensus contigated 5' ESTs, as well as their expression levels, may be determined as described in Example 18 below.

Characterization of the spatial and temporal expression patterns and expression levels of these mRNAs is useful for constructing expression vectors capable of producing a desired level of gene product in a desired spatial or temporal manner, as will be discussed in more detail below.

Furthermore, 5' ESTs and consensus contigated 5' ESTs whose corresponding mRNAs are associated with disease states may also be identified. For example, a particular disease may result from the lack of expression, over expression, or under expression of a mRNA corresponding to a 5' EST or consensus contigated 5' EST. By comparing mRNA expression patterns and quantities in samples taken from healthy individuals with those from individuals suffering from a particular disease, 5' ESTs or consensus contigated 5' ESTs responsible for the disease may be identified.

It will be appreciated that the results of the above characterization procedures for 5' ESTs and consensus contigated 5' ESTs also apply to extended cDNAs (obtainable as described below) which contain sequences adjacent to the 5' ESTs and consensus contigated 5' ESTs. It will also be appreciated that if desired, characterization may be delayed until extended cDNAs have been obtained rather than characterizing the 5' ESTs or consensus contigated 5' ESTs themselves.

EXAMPLE 18

Evaluation of Expression Levels and Patterns of mRNAs Corresponding to EST-Related Nucleic Acids Expression levels and patterns of mRNAs corresponding to EST-related nucleic acids may be analyzed by solution hybridization with long probes as described in International Patent Application No. WO 97/05277, the entire disclosure of which is incorporated herein by reference: Briefly, an EST-related nucleic acid, fragment of an EST-related nucleic acid, positional segment of an EST-related nucleic acid, or fragment of a positional segment of an EST-related nucleic acid corresponding to the gene encoding the mRNA to be characterized is inserted at a cloning site immediately downstream of a bacteriophage (T3, T7 or SP6) RNA polymerase promoter to produce antisense RNA. Preferably, the EST-related nucleic acid, fragment of an EST-related nucleic acid, positional segment of an EST-related nucleic acid, or fragment of a positional segment of an EST-related nucleic acid is 100 or more nucleotides in length. The plasmid is linearized and transcribed in the presence of ribonucleotides comprising modified ribonucleotides (i.e. biotin-UTP and DIG-UTP). An excess of this doubly labeled RNA is hybridized in solution with mRNA isolated from cells or tissues of interest. The hybridizations are performed under standard stringent conditions (40–50° C. for 16 hours in an 80% formamide, 0.4 M NaCl buffer, pH 7–8). The unhybridized probe is removed by digestion with ribonucleases specific for single-stranded RNA (i.e. RNases CL3, T1, Phy M, U2 or A). The presence of the biotin-UTP modification enables capture of the hybrid on a microtitration plate coated with streptavidin. The presence of the DIG modification enables the hybrid to be detected and quantified by ELISA using an anti-DIG antibody coupled to alkaline phosphatase.

The EST-related nucleic acid, fragment of an EST-related nucleic acid, positional segment of an EST-related nucleic acid, or fragment of a positional segment of an EST-related nucleic acid may also be tagged with nucleotide sequences for the serial analysis of gene expression (SAGE) as disclosed in UK Patent Application No. 2 305 241 A, the entire disclosure of which is incorporated herein by reference. In this method, cDNAs are prepared from a cell, tissue, organism or other source of nucleic acid for which gene expression patterns must be determined. The resulting cDNAs are separated into two pools. The cDNAs in each pool are cleaved with a first restriction endonuclease, called an anchoring enzyme, having a recognition site which is likely to be present at least once in most cDNAs. The fragments which contain the 5' or 3' most region of the cleaved cDNA are isolated by binding to a capture medium such as streptavidin coated beads. A first oligonucleotide linker having a first sequence for hybridization of an amplification primer and an internal restriction site for a so called tagging endonuclease is ligated to the digested cDNAs in the first pool. Digestion with the second endonuclease produces short tag fragments from the cDNAs.

A second oligonucleotide having a second sequence for hybridization of an amplification primer and an internal restriction site is ligated to the digested cDNAs in the second pool. The cDNA fragments in the second pool are also digested with the tagging endonuclease to generate short tag fragments derived from the cDNAs in the second pool. The tags resulting from digestion of the first and second pools with the anchoring enzyme and the tagging endonuclease are ligated to one another to produce so called ditags. In some embodiments, the ditags are concatamerized to produce ligation products containing from 2 to 200 ditags. The tag sequences are then determined and compared to the sequences of the EST-related nucleic acid, fragment of an EST-related nucleic acid, positional segment of an EST-related nucleic acid, or fragment of a positional segment of an EST-related nucleic acid to determine which 5' ESTs, consensus contigated 5' ESTs, or extended cDNAs are expressed in the cell, tissue, organism, or other source of nucleic acids from which the tags were derived. In this way, the expression pattern of the 5' ESTs, consensus contigated 5' ESTs, or extended cDNAs in the cell, tissue, organism, or other source of nucleic acids is obtained.

Quantitative analysis of gene expression may also be performed using arrays. As used herein, the term array means a one dimensional, two dimensional, or multidimensional arrangement of EST-related nucleic acids, fragments of EST-related nucleic acids, positional segments EST-related nucleic acids, or fragments of positional segments of EST-related nucleic acids. Preferably, the EST-related nucleic acids, fragments of EST-related nucleic acids, positional segments EST-related nucleic acids, or fragments of positional segments of EST-related nucleic acids are at least 10, 12, 15, 18, 20, 23, 25, 28, 30, 35, 40, or 50 nucleotides in length. More preferably, the EST-related nucleic acids, fragments of EST-related nucleic acids, positional segments EST-related nucleic acids, or fragments of positional segments of EST-related nucleic acids are at least 100 nucleotide long.

More preferably, the fragments are more than 100 nucleotides in length. In some embodiments, the EST-related nucleic acids, fragments of EST-related nucleic acids, positional segments EST-related nucleic acids, or fragments of positional segments of EST-related nucleic acids may be more than 500 nucleotides long.

For example, quantitative analysis of gene expression may be performed with EST-related nucleic acids, fragments of EST-related nucleic acids, positional segments EST-related nucleic acids, or fragments of positional segments of EST-related nucleic acids in a complementary DNA microarray as described by Schena et al. (*Science* 270:467–470, 1995; *Proc. Natl. Acad. Sci. U.S.A.* 93:10614–10619, the entire disclosure of which is incorporated herein by reference, 1996). EST-related nucleic acids, fragments of EST-related nucleic acids, positional segments EST-related nucleic acids, or fragments of positional segments of EST-related nucleic acids are amplified by PCR and arrayed from 96-well microtiter plates onto silylated microscope slides using high-speed robotics. Printed arrays are incubated in a humid chamber to allow rehydration of the array elements and rinsed, once in 0.2% SDS for 1 min, twice in water for 1 min and once for 5 min in sodium borohydride solution. The arrays are submerged in water for 2 min at 95° C., transferred into 0.2% SDS for 1 min, rinsed twice with water, air dried and stored in the dark at 25° C.

Cell or tissue mRNA is isolated or commercially obtained and probes are prepared by.,a single round of reverse transcription. Probes are hybridized to 1 cm$^2$ microarrays under a 14×14 mm glass coverslip for 6–12 hours at 60° C. Arrays are washed for 5 min at 25° C. in low stringency wash buffer (1×SSC/0.2% SDS), then for 10 min at room temperature in high stringency wash buffer (0.1×SSC/0.2% SDS). Arrays are scanned in 0.1×SSC using a fluorescence laser scanning device fitted with a custom filter set. Accurate differential expression measurements are obtained by taking the average of the ratios of two independent hybridizations.

Quantitative analysis of the expression of genes may also be performed with EST-related nucleic acids, fragments of EST-related nucleic acids, positional segments EST-related nucleic acids, or fragments of positional segments of EST-related nucleic acids in complementary DNA arrays as described by Pietu et al. (*Genome Research* 6:492–503, 1996), the entire disclosure of which is incorporated herein by reference. The EST-related nucleic acids, fragments of EST-related nucleic acids, positional segments EST-related nucleic acids, or fragments of positional segments of EST-related nucleic acids thereof are PCR amplified and spotted on membranes. Then, mRNAs originating from various tissues or cells are labeled with radioactive nucleotides. After hybridization and washing in controlled conditions, the hybridized mRNAs are detected by phospho-imaging or autoradiography. Duplicate experiments are performed and a quantitative analysis of differentially expressed mRNAs is then performed.

Alternatively, expression analysis of the EST-related nucleic acids, fragments of EST-related nucleic acids, positional segments EST-related nucleic acids, or fragments of positional segments of EST-related nucleic acids can be done through high density nucleotide arrays as described by Lockhart et al. (*Nature Biotechnology* 14: 1675–1680, 1996) and Sosnowsky et al. (*Proc. Natl. Acad. Sci.* 94:1119–1123, 1997), the entire disclosures of which are incorporated herein by reference. Oligonucleotides of 15–50 nucleotides corresponding to sequences of EST-related nucleic acids, fragments of EST-related nucleic acids, positional segments EST-related nucleic acids, or fragments of positional segments of EST-related nucleic acids are synthesized directly on the chip (Lockhart et al., supra) or synthesized and then addressed to the chip (Sosnowsky et al., supra). Preferably, the oligonucleotides are about 20 to 25 nucleotides in length.

cDNA probes labeled with an appropriate compound, such as biotin, digoxigenin or fluorescent dye, are synthesized from the appropriate mRNA population and then randomly fragmented to an average size of 50 to 100 nucleotides. The said probes are then hybridized to the chip. After washing as described in Lockhart et al, supra and application of different electric fields (Sonowsky et al, supra.), the dyes or labeling compounds are detected and quantified. Duplicate hybridizations are performed. Comparative analysis of the intensity of the signal originating from cDNA probes on the same target oligonucleotide in different cDNA samples indicates a differential expression of the mRNA corresponding to the 5' EST, consensus contigated 5' EST or extended cDNA from which the oligonucleotide sequence has been designed.

IV. Use of 5' ESTs to Clone Extended cDNAs and to Clone the Corresponding Genomic DNAs Once 5' ESTs or consensus contigated 5' ESTs which include the 5' end of the corresponding mRNAs have been selected using the procedures described above, they can be utilized to isolate extended cDNAs which contain sequences adjacent to the 5' ESTs or consensus contigated 5' ESTs. The extended cDNAs may include the entire coding sequence of the protein encoded by the corresponding mRNA, including the authentic translation start site. If the extended cDNA encodes a secreted protein, it'may contain the signal sequence, and the sequence encoding the mature protein remaining after cleavage of the signal peptide.

Extended cDNAs which include the entire coding sequence of the protein encoded by the corresponding mRNA are referred to herein as "full-length cDNAs." Alternatively, the extended cDNAs may not include the entire coding sequence of the protein encoded by the corresponding mRNA, although they do include sequences adjacent to the 5' ESTs or consensus contigated 5' ESTs. In some embodiments in which the extended cDNAs are derived from an mRNA encoding a secreted protein, the extended cDNAs may include only the sequence encoding the mature protein remaining after cleavage of the signal peptide, or only the sequence encoding the signal peptide.

Examples 19 and 20 below describe a general method for obtaining extended cDNAs using 5' ESTs or consensus contigated 5' ESTs and nucleic acid homologous thereto. Example 21 below describes the cloning and sequencing of several extended cDNAs, including full-length cDNAs which include the authentic 5' end of the corresponding mRNA for several secreted proteins.

The methods of Examples 19 and 20 can also be used to obtain extended cDNAs which encode less than the entire coding sequence of proteins encoded by the genes corresponding to the 5' ESTs or consensus contigated 5' ESTs. In some embodiments, the extended cDNAs isolated using these methods encode at least 5, 10, 15, 20, 25, 30, 35, 40, 50, 75, 100, or 150 consecutive amino acids of one of the proteins encoded by the sequences of SEQ ID NOs. 24–811 and 1600–1622. In some embodiments, the extended cDNAs isolated using these methods encode at least 5, 10, 15, 20, 25, 30, 35, 40, 50, 75, 100, or 150 consecutive amino acids of one of the proteins encoded by the sequences of SEQ ID NOs. 24–811.

EXAMPLE 19

Figure 3:
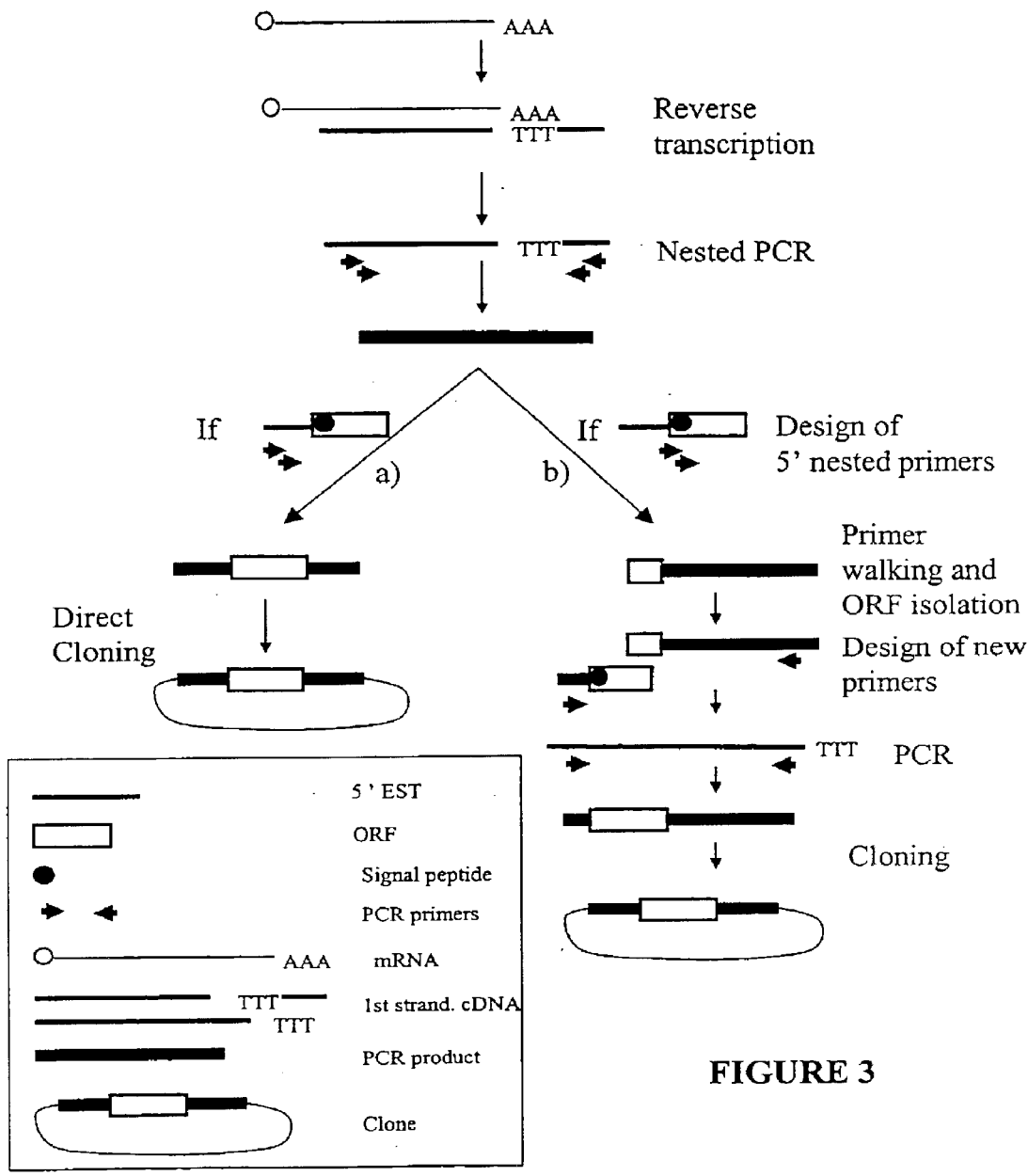
FIG. 3 summarizes a general method used to clone and sequence extended cDNAs containing sequences adjacent to 5'ESTs.

General Method for Using 5' ESTs or Consensus Contigated 5' ESTs to Clone and Sequence: Extended cDNAs which Include the Entire Coding Region and the Authentic 5' End of the Corresponding mRNA The following general method may be used to quickly and efficiently isolate extended cDNAs including sequence adjacent to the sequences of the 5' ESTs or Consensus Contigated 5'ESTs used to obtain them. This method may be applied to obtain extended cDNAs for any 5' EST or consensus contigated 5' EST of the invention, including those 5' ESTs and consensus contigated 5' ESTs encoding secreted proteins. This method is illustrated in FIG. 3.

1. Obtaining Extended cDNAs

The method takes advantage of the known 5' sequence of the mRNA. A reverse transcription reaction is conducted on purified mRNA with a poly dT primer containing a nucleotide sequence at its 5' end allowing the addition of a known sequence at the end of the cDNA which corresponds to the 3' end of the mRNA. Such a primer and a commercially-available reverse transcriptase enzyme are added to a buffered mRNA sample yielding a reverse transcript anchored at the 3' polyA site of the RNAs. Nucleotide monomers are then added to complete the first strand synthesis.

After removal of the mRNA hybridized to the first cDNA strand by alkaline hydrolysis, the products of the alkaline hydrolysis and the residual poly dT primer can be eliminated with an exclusion column.

Subsequently, a pair of nested primers on each end is designed based on the known 5'sequence from the 5' EST or consensus contigated 5' EST and the known 3' end added by the poly dT primer used in the first strand synthesis. Software used to design primers are either based on GC content and melting temperatures of oligonucleotides, such as OSP (Illier and Green, *PCR Meth. Appl.* 1:124–128, 1991), the entire disclosure of which is incorporated herein by reference, or based on the octamer frequency disparity method (Griffais et al., *Nucleic Acids Res.* 19: 3887–3891, 1991), the entire disclosure of which is incorporated herein by reference such as PC-Rare (http://bioinfomnatics.weizmann.ac.il/software/PC-Rare/doc/manuel.html). Preferably, the nested primers at the 5' end and the nested primers at the 3' end are separated from one another by four to nine bases. These primer sequences may be selected to have melting temperatures and specificities suitable for use in PCR.

A first PCR run is performed using the outer primer from each of the nested pairs. A second PCR run using the inner primer from each of the nested pairs is then performed on a small sample of the first PCR product. Thereafter, the primers and remaining nucleotide monomers are removed.

2. Sequencing Extended cDNAs or Fragments Thereof

Due to the lack of position constraints on the design of 5' nested primers compatible for PCR use using the OSP software, amplicons of two types are obtained. Preferably, the second 5' primer is located upstream of the translation initiation codon thus yielding a nested PCR product containing the entire coding sequence. Such an extended cDNA may be used in a direct cloning procedure as described in section a below. However, in some cases, the second 5' primer is located downstream of the translation initiation codon, thereby yielding a PCR product containing only part of the ORF. Such incomplete PCR products are submitted to a modified procedure described in section b below.

a) Nested PCR Products Containing Complete ORFs

When the resulting nested PCR product contains the complete coding sequence, as predicted from the 5' EST or consensus contigated 5' EST sequence, it is directly cloned in an appropriate vector as described in section 3.

b) Nested PCR Products Containing Incomplete ORFs

When the amplicon does not contain the complete coding sequence, intermediate steps are necessary to obtain both the complete coding sequence and a PCR product containing the full coding sequence. The complete coding sequence can be assembled from several partial sequences determined directly from different PCR products.

Once the full coding sequence has been completely determined, new primers compatible for PCR use are then designed to obtain amplicons containing the whole coding region. However, in such cases, 3' primers compatible for PCR use are located inside the 3'UTR of the corresponding mRNA, thus yielding amplicons which lack part of this region, i.e. the polyA tract and sometimes the polyadenylation signal, as illustrated in FIG. 3. Such extended cDNAs are then cloned into an appropriate vector as described in section 3.

c) Sequencing Extended cDNAs

Sequencing of extended cDNAs can be performed using a Die Terminator approach with the AmpliTaq DNA polymerase FS kit available from Perkin Elmer.

In order to sequence long PCR fragments, primer walking is performed using software such as OSP to choose primers and automated computer software such as ASMG (Sutton et al., *Genome Science Technol*. 1: 9–19, 1995), the entire disclosure of which is incorporated herein by reference, to construct contigs of walking sequences including the initial 5' tag. Preferably, primer walking is performed until the sequences of full length cDNAs are obtained.

Completion of the sequencing of a given extended cDNA fragment may be assessed by comparing the sequence length to the size of the corresponding nested PCR product. When Northern blot data are available, the size of the mRNA detected for a given PCR product may also be used to finally assess that the sequence is complete. Sequences which do not fulfill these criteria are discarded and will undergo a new isolation procedure.

3. Cloning Extended cDNAs

The PCR product containing the full coding sequence is then cloned in an appropriate vector. For example, the extended cDNAs can be cloned into any expression vector known in the art, such as pED6dpc2 (DiscoverEase, Genetics Institute, Cambridge, Mass.).

Cloned PCR products are then entirely sequenced in order to obtain at least two sequences per clone. Preferably, the sequences are obtained from both sense and antisense strands according to the aforementioned procedure with the following modifications. First, both 5' and 3' ends of cloned PCR products are sequenced in order to confirm the identity of the clone. Second, primer walking is performed if the full coding coding region has not been obtained yet. Contigation is then performed using primer walking sequences for cloned products as well as walking sequences that have already contigated for uncloned PCR products. The sequence is considered complete when the resulting contigs include the whole coding region as well as overlapping sequences with vector DNA on both ends. All the contigated sequences for each cloned amplicon are then used to obtain a consensus sequence.

4. Selection of Cloned Full Length Sequences a) Computer Analysis of Extended cDNAs Following identification of contaminants and masking of repeats, structural features, e.g. polyA tail and polyadenylation signal, of the sequences of extended cDNAs are subsequently determined using methods known to those skilled in the art. For example, algorithm, parameters and criteria defined in FIG. 5 may be used. Briefly, a polyA tail is defined as a homopolymeric stretch of at least 11 A with at most one alternative base within it. The polyA tail search is restricted to the last 20 nucleotides of the sequence and limited to stretches of 11 consecutive A's because sequencing reactions are often not readable after such a polyA stretch. To search for a polyadenylation signal, the polyA tail is clipped from the full-length sequence. The 50 nucleotides preceding the polyA tail are searched for the canonic polyadenylation AAUAAA signal allowing one mismatch to account for possible sequencing errors as well as known variation in the canonical sequence of the polyadenylation signal.

Functional features, e.g. ORFs and signal sequences, of the sequences of extended cDNAs are subsequently determined as follows. The 3 upper strand frames of extended cDNAs are searched for ORFs defined as the maximum length fragments beginning with a translation initiation codon and ending with a stop codon. ORFs encoding at least 80 amino acids are preferred. If extended cDNAs encoding secreted proteins are desired, each found ORF is then scanned for the presence of a signal peptide using the matrix method described in Example 13.

Sequences of extended cDNAs are then compared, on a nucleotidic or proteic basis, to public sequences available at the time of filing.

b) Selection of Full-length cDNAs of Interest

A negative selection may then be performed in order to eliminate unwanted cloned sequences resulting from either contaminants or PCR artifacts as follows. Sequences matching contaminant sequences such as vector DNA, tRNA, mtRNA, rRNA sequences are discarded as well as those encoding ORF sequences exhibiting extensive homology to repeats. Sequences obtained by direct cloning (section 1a) but lacking polyA tail may be discarded. Only ORFs ending either before the polyA tail (section 1a) or before the end of the cloned 3'UTR (section 1*b*) may be selected. If extended cDNAs encoding secreted proteins are desired, ORFs containing a signal peptide are considered. In addition, ORFs containing unlikely mature proteins such as mature proteins which size is less than 20 amino acids or less than 25% of the immature protein size may be eliminated.

Then, for each remaining full length cDNA containing several ORFs, a preselection of ORFs may be performed using the following criteria. The longest ORF is preferred. If extended cDNAs encoding secreted proteins are desired and if the ORF sizes are similar, the chosen ORF is the one which signal peptide has the highest score according to Von Heijne method.

Sequences of full length cDNA clones may then be compared pairwise after masking of the repeat sequences. Full-length cDNA sequences exhibiting extensive homology may be clustered in the same class. Each cluster may then be subjected to a cluster analysis that detects sequences resulting from internal priming or from alternative splicing, identical sequences or sequences with several frameshifts. A selection may be operated between clones belonging to the same class in order to detect clones encoding homologous but distinct ORFs which may be both selected if they both contain sequences of interest.

Selection of full-length cDNA clones encoding sequences of interest may subsequently be performed using the following criteria. Structural parameters (initial tag, polyadenylation site and signal) are first checked. Then, homologies with known nucleic acids and proteins are examined in order to determine whether the clone sequence match a known nucleotide/protein sequence and, in the latter case, its covering rate and the date at which the sequence became public. If there is no extensive match with sequences other than ESTs or genomic DNA, or if the clone sequence brings substantial new information, such as encoding a protein resulting from alternative splicing of an mRNA coding for an already known protein, the sequence is kept. Examples of such cloned full-length cDNAs containing sequences of interest are described in Example 21. Sequences resulting from chimera or double inserts or located on chromosome breaking points as assessed by homology to other sequences may be discarded during this procedure.

Extended cDNAs prepared as described above may be subsequently engineered to obtain nucleic acids which include desired portions of the extended cDNA using conventional techniques such as subcloning, PCR, or in vitro oligonucleotide synthesis. For example, nucleic acids which include only the full coding sequences may be obtained using techniques known to those skilled in the art. Alternatively, conventional techniques may be applied to obtain nucleic acids which contain only part of the coding sequences. In the case of nucleic acids encoding secreted proteins, nucleic acids containing only the coding sequence for the mature protein remaining after the signal peptide is cleaved off or nucleic acids which contain only the coding sequences for the signal peptides may be obtained.

Similarly, nucleic acids containing any other desired portion of the coding sequences for the encoded protein may be obtained. For example, the nucleic acid may contain at least 10, 15, 18, 20, 25, 28, 30, 35, 40, 50, 75, 100, 150, 200, 300, 400 or 500 consecutive bases of an extended cDNA.

Once an extended cDNA has been obtained, it can be sequenced to determine the amino acid sequence it encodes. Once the encoded amino acid sequence has been determined, one can create and identify any of the many conceivable cDNAs that will encode that protein by simply using the degeneracy of the genetic code. For example, allelic variants or other homologous nucleic acids can be identified as described below. Alternatively, nucleic acids encoding the desired amino acid sequence can be synthesized in vitro.

In a preferred embodiment, the coding sequence may be selected using the known codon or codon pair preferences for the host organism in which the cDNA is to be expressed.

In addition to PCR based methods for obtaining cDNAs which include the authentic 5'end of the corresponding mRNA as well as the complete protein coding sequence of the corresponding mRNA, traditional hybridization based methods may also be employed. These methods may also be used to obtain the genomic DNAs which encode the mRNAs from which the 5' ESTs or consensus contigated 5' ESTS were derived, mRNAs corresponding to the extended cDNAs, or nucleic acids which are homologous to extended cDNAs, 5' ESTs, or consensus contigated 5' ESTs. Example 20 below provides examples of such methods.

EXAMPLE 20

Methods for Obtaining Extended cDNAs which Include the Entire Coding Region and the Authentic 5' End of the Corresponding mRNA or Nucleic Acids Homologous to Extended cDNAs, 5' ESTs or Consensus Contigated 5' ESTs A full-length cDNA library can be made using the strategies described in Example 7. Alternatively, a cDNA library or genomic DNA library may be obtained from a commercial source or made using techniques familiar to those skilled in the art.

Such cDNA or genomic DNA libraries may be used to isolate extended cDNAs obtained from 5' ESTs or consensus contigated 5' ESTs or nucleic acids homologous to extended cDNAs, 5' ESTs, or consensus contigated 5' ESTs as follows. The cDNA library or genomic DNA library is hybridized to a detectable probe. The detectable probe may comprise at least 10, 15, 18, 20, 25, 28, 30, 35, 40, 50, 75, 100, 150, 200, 300, 400 or 500 consecutive nucleotides of the 5' EST, consensus contigated 5' EST, or extended cDNA.

Techniques for identifying cDNA clones in a cDNA library which hybridize to a given probe sequence are disclosed in Sambrook et al., *Molecular Cloning: A Laboratory Manual* 2d Ed., Cold Spring Harbor Laboratory Press, 1989, the entire disclosure of which is incorporated herein by reference. The same techniques may be used to isolate genomic DNAs. Briefly, cDNA or genomic DNA clones which hybridize to the detectable probe are identified and isolated for further manipulation as follows. The detectable probe described in the preceding paragraph is labeled with a detectable label such as a radioisotope or a fluorescent molecule. Techniques for labeling the probe are well known and include phosphorylation with polynucleotide kinase, nick translation, in vitro transcription, and non radioactive techniques. The cDNAs or genomic DNAs in the library are transferred to a nitrocellulose or nylon filter and denatured. After blocking of non specific sites, the filter is incubated with the labeled probe for an amount of time sufficient to allow binding of the probe to cDNAs or genomic DNAs containing a sequence capable of hybridizing thereto.

By varying the stringency of the hybridization conditions used to identify cDNAs or genomic DNAs which hybridize to the detectable probe, cDNAs or genomic DNAs having different levels of homology to the probe can be identified and isolated as described below.

1. Identification of cDNA or Genomic DNA Sequences Having a High Degree of Homolozy to the Labeled Probe.

To identify cDNAs or genomic DNAs having a high degree of homology to the probe sequence, the melting temperature of the probe may be calculated using the following formulas:

For probes between 14 and 70 nucleotides in length the melting temperature (Tm) is calculated using the formula: $Tm = 81.5 + 16.6(\log (Na^+)) + 0.41(\text{fraction } G+C) - (600/N)$ where N is the length of the probe.

If the hybridization is carried out in a solution containing formamide, the melting temperature may be calculated using the equation $Tm = 81.5 + 16.6(\log (Na+)) + 0.41(\text{fraction } G+C) - (0.63\% \text{ formamide}) - (600/N)$ where N is the length of the probe.

Prehybridization may be carried out in 6×SSC, 5× Denhardt's reagent, 0.5% SDS, 100 μg denatured fragmented salmon sperm DNA or 6×SSC, 5× Denhardt's reagent, 0.5% SDS, 100 μg denatured fragmented salmon sperm DNA, 50% formamide. The formulas for SSC and Denhardt's solutions are listed in Sambrook et al., supra.

Hybridization is conducted by adding the detectable probe to the prehybridization solutions listed above. Where the probe comprises double stranded DNA, it is denatured before addition to the hybridization solution. The filter is contacted with the hybridization solution for a sufficient period of time to allow the probe to hybridize to extended cDNAs or genomic DNAs containing sequences complementary thereto or homologous thereto. For probes over 200 nucleotides in length, the hybridization may be carried out at 15–25° C. below the Tm. For shorter probes, such as oligonucleotide probes, the hybridization may be conducted at 15–25° C. below the Tm. Preferably, for hybridizations in 6×SSC, the hybridization is conducted at approximately 68° C. Preferably, for hybridizations in 50% formamide containing solutions, the hybridization is conducted at approximately 42° C.

All of the foregoing hybridizations would be considered to be under "stringent" conditions.

Following hybridization, the filter is washed in 2×SSC, 0.1% SDS at room temperature for 15 minutes. The filter is then washed with 0.1×SSC, 0.5% SDS at room temperature for 30 minutes to 1 hour. Thereafter, the solution is washed at the hybridization temperature in 0.1×SSC, 0.5% SDS. A final wash is conducted in 0.1×SSC at room temperature.

cDNAs or genomic DNAs which have hybridized to the probe are identified by autoradiography or other conventional techniques.

2. Obtaining cDNA or Genomic DNA Sequences Having Lower Degrees of Homology to the Labeled Probe The above procedure may be modified to identify cDNAs or genomic DNAs having decreasing levels of homology to the probe sequence. For example, to obtain cDNAs or genomic DNAs of decreasing homology to the detectable probe, less stringent conditions may be used. For example, the hybridization temperature may be decreased in increments of 5° C. from 68° C. to 42° C. in a hybridization buffer having a sodium concentration of approximately 1M. Following hybridization, the filter may be washed with 2×SSC, 0.5% SDS at the temperature of hybridization. These conditions are considered to be "moderate" conditions above 50° C. and "low" conditions below 50° C.

Alternatively, the hybridization may be carried out in buffers, such as 6×SSC, containing formamide at a temperature of 42° C. In this case, the concentration of formamide in the hybridization buffer may be reduced in 5% increments from 50% to 0% to identify clones having decreasing levels of homology to the probe. Following hybridization, the filter may be washed with 6×SSC, 0.5% SDS at 50° C. These conditions are considered to be "moderate" conditions above 25% formamide and "low" conditions below 25% formamide. cDNAs or genomic DNAs which have hybridized to the probe are identified by autoradiography.

3. Determination of the Degree of Homology between the Obtained cDNAs or Genomic DNAs and 5'ESTs. Consensus Contigated 5'ESTs, or Extended cDNAs or Between the Polypeptides Encoded by the Obtained cDNAs or Genomic DNAs and the Polypeptides Encoded by the 5'ESTs, Consensus Contigated 5'ESTs, or Extended cDNAs To determine the level of homology between the hybridized cDNA or genomic DNA and the 5'EST, consensus contigated 5'EST or extended cDNA from which the probe was derived, the nucleotide sequences of the hybridized nucleic acid and the 5'EST, consensus contigated 5'EST or extended cDNA from which the probe was derived are compared. The sequences of the 5'EST, consensus contigated 5'EST or extended cDNA from which the probe was derived and the sequences of the cDNA or genomic DNA which hybridized to the detectable probe may be stored on a computer readable medium as described below and compared to one another using any of a variety of algorithms familiar to those skilled in the art, those described below.

To determine the level of homology between the polypeptide encoded by the hybridizing cDNA or genomic DNA and the polypeptide encoded by the 5'EST, consensus contigated 5'EST or extended cDNA from which the probe was derived, the polypeptide sequence encoded by the hybridized nucleic acid and the polypeptide sequence encoded by the 5'EST, consensus contigated 5'EST or extended cDNA from which the probe was derived are compared. The sequences of the polypeptide encoded by the 5'EST, consensus contigated 5'EST or extended cDNA from which the probe was derived and the polypeptide sequence encoded by the cDNA or genomic DNA which hybridized to the detectable probe may be stored on a computer readable medium as described below and compared to one another using any of a variety of algorithms familiar to those skilled in the art, those described below.

Protein and/or nucleic acid sequence homologies may be evaluated using any of the variety of sequence comparison algorithms and programs known in the art. Such algorithms and programs include, but are by no means limited to, TBLASTN, BLASTP, FASTA, TFASTA, and CLUSTALW (Pearson and Lipman, 1988, *Proc. Natl. Acad. Sci. USA* 85(8):2444–2448; Altschul et al., 1990, *J. Mol. Biol.* 215(3):403410; Thompson et al., 1994, *Nucleic Acids Res.* 22 (2):4673–4680; Higgins et al., 1996, *Methods Enzynol.* 266:383–402; Altschul et al., 1990, *J. Mol. Biol.* 215(3):403410; Altschul et al., 1993, *Nature Genetics* 3:266–272), the entire disclosures of which are incorporated herein by reference.

In a particularly preferred embodiment, protein and nucleic acid sequence homologies are evaluated using the Basic Local Alignment Search Tool ("BLAST") which is well known in the art (see, e.g., Karlin and Altschul, 1990, *Proc. Natl. Acad. Sci. USA* 87:2267–2268; Altschul et al., 1990, *J. Mol. Biol.* 215:403–410; Altschul et al., 1993, *Nature Genetics* 3:266–272; Altschul et al., 1997, *Nuc. Acids Res.* 25:3389–3402), the entire disclosures of which are incorporated herein by reference. In particular, five specific BLAST programs are used to perform the following task:

(1) BLASTP and BLAST3 compare an amino acid query sequence against a protein sequence database;
(2) BLASTN compares a nucleotide query sequence against a nucleotide sequence database;
(3) BLASTX compares the six-frame conceptual translation products of a query nucleotide sequence (both strands) against a protein sequence database;
(4) TBLASTN compares a query protein sequence against a nucleotide sequence database translated in all six reading frames (both strands); and
(5) TBLASTX compares the six-frame translations of a nucleotide query sequence against the six-frame translations of a nucleotide sequence database.

The BLAST programs identify homologous sequences by identifying similar segments, which are referred to herein as "high-scoring segment pairs," between a query amino or nucleic acid sequence and a test sequence which is preferably obtained from a protein or nucleic acid sequence database. High-scoring segment pairs are preferably identified (i.e., aligned) by means of a scoring matrix, many of which are known in the art. Preferably, the scoring matrix used is the BLOSUM62 matrix (Gonnet et al., 1992, *Science* 256:1443–1445; Henikoff and Henikoff, 1993, *Proteins* 17:4941), the entire disclosures of which are incorporated herein by reference. Less preferably, the PAM or PAM250 matrices may also be used (see, e.g., Schwartz and Dayhoff, eds., 1978, *Matrices for Detecting Distance Relationships: Atlas of Protein Sequence and Structure*, Washington: National Biomedical Research Foundation), the entire disclosure of which is incorporated herein by reference.

The BLAST programs evaluate the statistical significance of all high-scoring segment pairs identified, and preferably selects those segments which satisfy a user-specified threshold of significance, such as a user-specified percent homology. Preferably, the statistical significance of a high-scoring segment pair is evaluated using the statistical significance formula of Karlin (see, e.g., Karlin and Altschul, 1990, *Proc. Natl. Acad. Sci. USA* 87:2267–2268), the entire disclosure of which is incorporated herein by reference.

The parameters used with the above algorithms may be adapted depending on the sequence length and degree of homology studied. In some embodiments, the parameters may be the default parameters used by the algorithms in the absence of instructions from the user.

In some embodiments, the level of homology between the hybridized nucleic acid and the extended cDNA, 5'EST, or 5' consensus contigated 5'EST from which the probe was derived may be determined using the FASTDB algorithm described in Brutlag et al. Comp. App. Biosci. 6:237–245, 1990, the entire disclosure of which is incorporated herein by reference. In such analyses the parameters may be selected as follows: Matrix=Unitary, k-tuple=4, Mismatch Penalty=1, Joining Penalty=30, Randomization Group Length=0, Cutoff Score=1, Gap Penalty=5, Gap Size Penalty=0.05, Window Size=500 or the length of the sequence which hybridizes to the probe, whichever is shorter. Because the FASTDB program does not consider 5' or 3' truncations when calculating homology levels, if the sequence which hybridizes to the probe is truncated relative to the sequence of the extended cDNA, 5'EST, or consensus contigated 5'EST from which the probe was derived the homology level is manually adjusted by calculating the number of nucleotides of the extended cDNA, 5'EST, or consensus contigated 5' EST which are not matched or aligned with the hybridizing sequence, determining the percentage of total nucleotides of the hybridizing sequence which the non-matched or non-aligned nucleotides represent, and subtracting this percentage from the homology level. For example, if the hybridizing sequence is 700 nucleotides in length and the extended cDNA, 5'EST, or consensus contigated 5' EST sequence is 1000 nucleotides in length wherein the first 300 bases at the 5' end of the extended cDNA, 5'EST, or consensus contigated 5' EST are absent from the hybridizing sequence, and wherein the overlapping 700 nucleotides are identical, the homology level would be adjusted as follows. The non-matched, non-aligned 300 bases represent 30% of the length of the extended cDNA, 5'EST, or consensus contigated 5' EST. If the overlapping 700 nucleotides are 100% identical, the adjusted homology level would be 100−30=70% homology. It should be noted that the preceding adjustments are only made when the non-matched or non-aligned nucleotides are at the 5' or 3' ends. No adjustments are made if the non-matched or non-aligned sequences are internal or under any other conditions.

For example, using the above methods, nucleic acids having at least 95% nucleic acid homology, at least 96% nucleic acid homology, at least 97% nucleic acid homology, at least 98% nucleic acid homology, at least 99% nucleic acid homology, or more than 99% nucleic acid homology to the extended cDNA, 5'EST, or consensus contigated 5' EST from which the probe was derived may be obtained and identified. Such nucleic acids may be allelic variants or related nucleic acids from other species. Similarly, by using progressively less stringent hybridization conditions one can obtain and identify nucleic acids having at least 90%, at least 85%, at least 80% or at least 75% homology to the extended cDNA, 5' EST, or consensus contigated 5' EST from which the probe was derived.

Using the above methods and algorithms such as FASTA with parameters depending on the sequence length and degree of homology studied, for example the default parameters used by the algorithms in the absence of instructions from the user, one can obtain nucleic acids encoding proteins having at least 99%, at least 98%, at least 97%, at least 96%, at least 95%, at least 90%, at least 85%, at least 80% or at least 75% homology to the protein encoded by the extended cDNA, 5'EST, or consensus contigated 5' EST from which the probe was derived. In some embodiments, the homology levels can be determined using the "default" opening penalty and the "default" gap penalty, and a scoring matrix such as PAM 250 (a standard scoring matrix; see Dayhoff et al., in: Atlas of Protein Sequence and Structure, Vol. 5, Supp. 3 (1978)), the entire disclosure of which is incorporated herein by reference.

Alternatively, the level of polypeptide homology may be determined using the FASTDB algorithm described by Brutlag et al. Comp. App. Biosci. 6:237–245, 1990, the entire disclosure of which is incorporated herein by reference. In such analyses the parameters may be selected as follows: Matrix=PAM 0, k-tuple=2, Mismatch Penalty=1, Joining Penalty=20, Randomization Group Length=0, Cutoff Score= 1, Window Size=Sequence Length, Gap Penalty=5, Gap Size Penalty=0.05, Window Size=500 or the length of the homologous sequence, whichever is shorter. If the homologous amino acid sequence is shorter than the amino acid sequence encoded by the extended cDNA, 5'EST, or consensus contigated 5' EST as a result of an N terminal and/or C terminal deletion the results may be manually corrected as follows. First, the number of amino acid residues of the amino acid sequence encoded by the extended cDNA, 5'EST, or consensus contigated 5' EST which are not matched or aligned with the homologous sequence is determined. Then, the percentage of the length of the sequence encoded by the extended cDNA, 5'EST, or consensus contigated 5' EST which the non-matched or non-aligned amino acids represent is calculated. This percentage is subtracted from the homology level. For example wherein the amino acid sequence encoded by the extended cDNA, 5'EST, or consensus contigated 5' EST is 100 amino acids in length and the length of the homologous sequence is 80 amino acids and wherein the amino acid sequence encoded by the extended cDNA or 5'EST is truncated at the N terminal end with respect to the homologous sequence, the homology level is calculated as follows. In the preceding scenario there are 20 non-matched, non-aligned amino acids in the sequence encoded by the extended cDNA, 5'EST, or consensus contigated 5' EST. This represents 20% of the length of the amino acid sequence encoded by the extended cDNA, 5'EST, or consensus contigated 5' EST. If the remaining amino acids are 1005 identical between the two sequences, the homology level would be 10%–20%=80% homology. No adjustments are made if the non-matched or non-aligned sequences are internal or under any other conditions.

In addition to the above described methods, other protocols are available to obtain extended cDNAs using 5' ESTs or consensus contigated 5'ESTs as outlined in the following paragraphs.

Extended cDNAs may be prepared by obtaining mRNA from the tissue, cell, or organism of interest using mRNA preparation procedures utilizing polyA selection procedures or other techniques known to those skilled in the art. A first primer capable of hybridizing to the polyA tail of the mRNA is hybridized to the mRNA and a reverse transcription reaction is performed to generate a first cDNA strand.

The first cDNA strand is hybridized to a second primer containing at least 10 consecutive nucleotides of the sequences of SEQ ID NOs 24–811 and 1600–1622. Preferably, the primer comprises at least 10, 12, 15, 17, 18, 20, 23, 25, or 28 consecutive nucleotides from the sequences of SEQ ID NOs 24–811 and 1600–1622. In some embodiments, the primer comprises more than 30 nucleotides from the sequences of SEQ ID NOs 24–811 and 1600–1622. If it is desired to obtain extended cDNAs containing the full protein coding sequence, including the authentic translation initiation site, the second primer used contains sequences located upstream of the translation initiation site. The second primer is extended to generate a second cDNA strand complementary to the first cDNA strand. Alternatively, RT-PCR may be performed as described above using primers from both ends of the cDNA to be obtained.

Extended cDNAs containing 5' fragments of the mRNA may be prepared by hybridizing an mRNA comprising the sequences of SEQ ID NOs. 24–811 and 1600–1622 with a primer comprising a complementary to a fragment of an EST-related nucleic acid hybridizing the primer to the mRNAs, and reverse transcribing the hybridized primer to make a first cDNA strand from the mRNAs. Preferably, the primer comprises at least 10, 12, 15, 17, 18, 20, 23, 25, or 28 consecutive nucleotides of the sequences complementary to SEQ ID NOs. 24–811 and 1600–1622.

Thereafter, a second cDNA strand complementary to the first cDNA strand is synthesized. The second cDNA strand may be made by hybridizing a primer complementary to sequences in the first cDNA strand to the first cDNA strand and extending the primer to generate the second cDNA strand.

The double stranded extended cDNAs made using the methods described above are isolated and cloned. The extended cDNAs may be cloned into vectors such as plasmids or viral vectors capable of replicating in an appropriate host cell. For example, the host cell may be a bacterial, mammalian, avian, or insect cell.

Techniques for isolating mRNA, reverse transcribing a primer hybridized to mRNA to generate a first cDNA strand, extending a primer to make a second cDNA strand complementary to the first cDNA strand, isolating the double stranded cDNA and cloning the double stranded cDNA are well known to those skilled in the art and are described in *Current Protocols in Molecular Biology*, John Wiley & Sons, Inc. 1997 and Sambrook et al., Molecular Cloning: A Laboratory Manual, Second Edition, Cold Spring Harbor Laboratory Press, 1989.

Alternatively, other procedures may be used for obtaining full-length cDNAs or extended cDNAs. In one approach, full-length or extended cDNAs are prepared from mRNA and cloned into double stranded phagemids as follows. The cDNA library in the double stranded phagemids is then rendered single stranded by treatment with an endonuclease, such as the Gene H product of the phage F1 and an exonuclease (Chang et al, *Gene* 127:95–8, 1993), the entire disclosure of which is incorporated herein by reference. A biotinylated oligonucleotide comprising the sequence of a fragment of an EST-related nucleic acid is hybridized to the single stranded phagemids. Preferably, the fragment comprises at least 10, 12, 15, 17, 18, 20, 23, 25, or 28 consecutive nucleotides of the sequences of SEQ ID NOs. 24–811 and 1600–1622.

Hybrids between the biotinylated oligonucleotide and phagemids are isolated by incubating the hybrids with streptavidin coated paramagnetic beads and retrieving the beads with a magnet (Fry et al., *Biotechniques*, 13: 124–131, 1992), the entire disclosure of which is incorporated herein by reference. Thereafter, the resulting phagemids are released from the beads and converted into double stranded DNA using a primer specific for the 5' EST or consensus contigated 5'EST sequence used to design the biotinylated oligonucleotide. Alternatively, protocols such as the Gene Trapper kit (Gibco BRL) may be used. The resulting double stranded DNA is transformed into bacteria. Extended cDNAs or full length cDNAs containing the 5' EST or consensus contigated 5'EST sequence are identified by colony PCR or colony hybridization.

Using any of the above described methods in section III, a plurality of extended cDNAs containing full-length protein coding sequences or portions of the protein coding sequences may be provided as cDNA libraries for subsequent evaluation of the encoded proteins or use in diagnostic assays as described below.

EXAMPLE 21

Full Length cDNAs

The procedures described in Example 19 and 20 were used to obtain extended cDNAs or full length cDNAs derived from 5' ESTs in a variety of tissues. The following list provides a few examples of cDNAs obtained by these means.

Using this procedure, the fall length cDNA of SEQ ID NO:1 (internal identification number 58-34-2-E7-FL2) was obtained. This cDNA encodes the signal peptide MWW-FQQGLSFLPSALVIWTSA (SEQ ID NO:2) having a von Heijne score of 5.5.

Using this approach, the full length cDNA of SEQ ID NO:3 (internal identification number 48-19-3-G1-FL1) was obtained. This cDNA encodes the signal peptide MKKV-LLLITAILAVAVG (SEQ ID NO: 4) having a von Heijne score of 8.2.

The full length cDNA of SEQ ID NO:5 (internal identification number 58-35-2-F10-FL2) was also obtained using this procedure. This cDNA encodes a signal peptide LWLL-FFLVTAIHA (SEQ ID NO:6) having a von Heijne score of 10.7.

Furthermore, the polypeptides encoded by the extended or full-length cDNAs may be screened for the presence of known structural or functional motifs or for the presence of signatures, small amino acid sequences which are well conserved amongst the members of a protein family. The results obtained for the polypeptides encoded by a few full-length cDNAs derived from 5'ESTs that were screened for the presence of known protein signatures and motifs using the Proscan software from the GCG package and the Prosite 15.0 database are provided below.

The protein of SEQ ID NO: 8 encoded by the full-length cDNA SEQ ID NO: 7 (internal designation 78-8-3-E6-CL0__1C) and expressed in adult prostate belong to the phosphatidylethanolamine-binding protein from which it exhibits the characteristic PROSITE signature from positions 90 to 112. Proteins from this widespread family, from nematodes to fly, yeast, rodent and primate species, bind hydrophobic ligands such as phospholipids and nucleotides. They are mostly expressed in brain and in testis and are thought to play a role in cell growth and/or maturation, in regulation of the sperm maturation, motility and in membrane remodeling. They may act either through signal transduction or through oxidoreduction reactions (for a review see Schoentgen and Jollès, *FEBS Letters*, 369:22–26 (1995), the entire disclosure of which is incorporated herein by reference). Taken together, these data suggest that the protein of SEQ ID NO: 8 may play a role in cell growth, maturation and in membrane remodeling and/or may be related to male fertility. Thus, these protein may be useful in diagnosing and/or treating cancer, neurodegenerative diseases, and/or disorders related to male fertility and sterility.

The protein of SEQ ID No. 10 encoded by the full-length cDNA SEQ ID NO. 9 (internal designation 108-013-5-O-H9-FLC) shows homologies with a family of lysophospholipases conserved among eukaryotes (yeast, rabbit, rodents and human). In addition, some members of this family exhibit a calcium-independent phospholipase A2 activity (Portilla et al, *J. Am. Soc. Nephro.*, 9:1178–1186 (1998), the entire disclosure of which is incorporated herein by reference). All members of this family exhibit the active site consensus GXSXG motif of carboxylesterases that is also found in the protein of SEQ ID NO. 10 (position 54 to 58). In addition, this protein may be a membrane protein with one transmembrane domain as predicted by the software TopPred II (Claros and von Heijne, *CABIOS applic. Notes*, 10:685686 (1994), the entire disclosure of which is incorporated herein by reference). Taken together, these data suggest that the protein of SEQ ID NO:10 may play a role in fatty acid metabolism, probably as a phospholipase. Thus, this protein or part therein, may be useful in diagnosing and/or treating several disorders including, but not limited to, cancer, diabetes, and neurodegenerative disorders such as Parkinson's and Alzheimer's diseases. It may also be useful in modulating inflammatory responses to infectious agents and/or to suppress graft rejection.

The protein of SEQ ID NO: 12 encoded by the full-length cDNA SEQ ID NO: 11 (internal designation 108-004-5-0-D10-FLC) shows remote homology to a subfamily of beta4-galactosyltransferases widely conserved in animals (human, rodents, cow and chicken). Such enzymes, usually type II membrane proteins located in the endoplasmic reticulum or in the Golgi apparatus, catalyzes the biosynthesis of glycoproteins, glycolipid glycans and lactose. Their characteristic features defined as those of subfamily A in Breton et al, *J. Biochem.*, 123:1000–1009 (1998), the entire disclosure of which is incorporated herein by reference are pretty well conserved in the protein of SEQ ID NO: 12, especially the region I containing the DVD motif (positions 1 14–116) thought to be involved either in UDP binding or in the catalytic process itself. In addition, the protein of SEQ ID NO: 12 has the typical structure of a type II protein. Indeed, it contains a short 28-amino-acid-long N-terminal tail, a transmembrane segment from positions 29 to 49 and a large 278-amino-acid-long C-terminal tail as predicted by the software TopPred II (Claros and von Heijne, *CABIOS applic. Notes*, 10 :685–86 (1994)). Taken together, these data suggest that the protein of SEQ ID NO: 12 may play a role in the biosynthesis of polysaccharides, and of the carbohydrate moieties of glycoproteins and glycolipids and/or in cell-cell recognition. Thus, this protein may be useful in diagnosing and/or treating several types of disorders including, but not limited to, cancer, atherosclerosis, cardiovascular disorders, autoimmune disorders and rheumatic diseases including rheumatoid arthritis.

The protein of SEQ ID NO: 14 encoded by the full-length cDNA SEQ ID NO: 13 (internal designation 108-009-5-0-A2-FLC) shows extensive homology to the bZIP family of transcription factors, and especially to the human luman protein (Lu et al., *Mol. Cell. Biol.*, 17 :5117–5126 (1997), the entire disclosure of which is incorporated herein by reference). The match include the whole bZIP domain composed of a basic DNA-binding domain and of a leucine zipper allowing protein dimerization. The basic domain is conserved in the protein of SEQ ID NO: 14 as shown by the characteristic PROSITE signature (positions 224–237) except for a conservative substitution of a glutamic acid with an aspartic acid in position 233. The typical PROSITE signature for leucine zipper is also present (positions 259 to 280). Taken together, these data suggest that the protein of SEQ ID NO: 14 may bind to DNA, hence regulating gene expression as a transcription factor. Thus, this protein may be useful in diagnosing and/or treating several types of disorders including, but not limited to, cancer.

Bacterial clones containing plasmids containing the full length cDNAs described above are presently stored in the inventor's laboratories under the internal identification numbers provided above. The inserts may be recovered from the deposited materials by growing an aliquot of the appropriate bacterial clone in the appropriate medium. The plasmid DNA can then be isolated using plasmid isolation procedures familiar to those skilled in the art such as alkaline lysis minipreps or large scale alkaline lysis plasmid isolation procedures. If desired the plasmid DNA may be further enriched by centrifugation on a cesium chloride gradient, size exclusion chromatography, or anion exchange chromatography. The plasmid DNA obtained using these procedures may then be manipulated using standard cloning techniques familiar to those skilled in the art. Alternatively, a PCR can be done with primers designed at both ends of the insertion. The PCR product which corresponds to the cDNA insert can then be manipulated using standard cloning techniques familiar to those skilled in the art.

V. Expression of Proteins or Polypeptides Encoded by EST-Related Nucleic Acids or Fragments Thereof EST-related nucleic acids, fragments of EST-related nucleic acids, positional segments of EST-related nucleic acids, and fragments of positional segments of EST-related nucleic acids may be used to express the polypeptides which they encode. In particular, they may be used to express EST-related polypeptides, fragments of EST-related polypeptides, positional segments of EST-related polypeptides, or fragments of positional segments of EST-related polypeptides. In some embodiments, the EST-related nucleic acids, positional segments of EST-related nucleic acids, and fragments of positional segments of EST-related nucleic acids may be used to express the full polypeptide (i.e. the signal peptide and the mature polypeptide) of a secreted protein, the mature protein (i.e. the polypeptide generated after cleavage of the signal peptide), or the signal peptide of a secreted protein. If desired, nucleic acids encoding the signal peptide may be used to facilitate secretion of the expressed protein. It will be appreciated that a plurality of EST-related nucleic acids, fragments of EST-related nucleic acids, positional segments of EST-related nucleic acids, or fragments of positional segments of EST-related nucleic acids may be simultaneously cloned into expression vectors to create an expression library for analysis of the encoded proteins as described below.

EXAMPLE 22

Expression of the Proteins Encoded by the Genes Corresponding to the 5'ESTs or Consensus Contigated 5' ESTs To express their encoded proteins, the EST-related nucleic acids, fragments of EST-related nucleic acids, positional segments of EST-related nucleic acids, or fragments of positional segments of EST-related nucleic acids are cloned into a suitable expression vector. In some instances, nucleic acids encoding EST-related polypeptides, fragments of EST-related polypeptides, positional segments of EST-related polypepbdes or fragments of positional segments of EST-related polypeptides may be cloned into a suitable expression vector.

In some embodiments, the nucleic acids inserted into the expression vector may comprise the coding sequence of a sequence selected from the group consisting of SEQ ID NOs. 24–811. In other embodiments, the nucleic acids inserted into the expression vector may comprise may comprise the full coding sequence (i.e. the nucleotides encoding the signal peptide and the mature polypeptide) of one of SEQ ID Nos. 766–792. In some embodiments, the nucleic acid inserted into the expression vector may comprise the nucleotides of one of the sequences of SEQ ID Nos. 766–792 which encode the mature polypeptide (i.e. the nucleotides encoding the polypeptide generated after cleavage of the signal peptide). In further embodiments, the nucleic acids inserted into the expression vector may comprise the nucleotides of 24–728 and 766–792 which encode the signal peptide to facilitate secretion of the expressed protein. The nucleic acids inserted into the expression vectors may also contain sequences upstream of the sequences encoding the signal peptide, such as sequences which regulate expression levels or sequences which confer tissue specific expression.

The nucleic acid inserted into the expression vector may encode a polypeptide comprising the one of the sequences of SEQ ID Nos. 812–1599. In some embodiments, the nucleic acid inserted into the expression vector may encode the full polypeptide sequence (i.e. the signal peptide and the mature polypeptide) included in one of SEQ ID Nos. 1554–1580. In other embodiments, the nucleic acid inserted into the expression vector may encode the mature polypeptide (i.e. the polypeptide generated after cleavage of the signal peptide) included in one of the sequences of SEQ ID Nos. 1554–1580. In further embodiments, the nucleic acids inserted into the expression vector may encode the signal peptide included in one of the sequences of 812–1516 and 1554–1580.

The nucleic acid encoding the protein or polypeptide to be expressed is operably linked to a promoter in an expression vector using conventional cloning technology. The expression vector may be any of the mammalian, yeast, insect or bacterial expression systems known in the art. Commercially available vectors and expression systems are available from a variety of suppliers including Genetics Institute (Cambridge, Mass.), Stratagene (La Jolla, Calif.), Promega (Madison, Wis.), and Invitrogen (San Diego, Calif.). If desired, to enhance expression and facilitate proper protein folding, the codon context and codon pairing of the sequence may be optimized for the particular expression organism in which the expression vector is introduced, as explained by Hatfield, et al., U.S. Pat. No. 5,082,767, the entire disclosure of which is incorporated herein by reference.

The following is provided as one exemplary method to express the proteins encoded by the nucleic acids described above. In some instances the nucleic acid encoding the protein or polypeptide to be expressed includes a methionine initiation codon and a polyA signal. If the nucleic acid encoding the polypeptide to be expressed lacks a methionine to serve as the initiation site, an initiating methionine can be introduced next to the first codon of the nucleic acid using conventional techniques. Similarly, if the nucleic acid encoding the protein or polypeptide to be expressed lacks a polyA signal, this sequence can be added to the construct by, for example, splicing out the polyA signal from pSG5 (Stratagene) using BglI and SalI restriction endonuclease enzymes and incorporating it into the mammalian expression vector pXT1 (Stratagene). pX1 contains the LTRs and a portion of the gag gene from Moloney Murine Leukemia Virus. The position of the LTRs in the construct allow efficient stable transfection. The vector includes the Herpes Simplex thymidine kinase promoter and the selectable neomycin gene. The nucleic acid encoding the polypeptide to be expressed is obtained by PCR from the bacterial vector using oligonucleotide primers complementary to the nucleic acid encoding the protein or polypeptide to be expressed and containing restriction endonuclease sequences for Pst I incorporated into the 5'primer and BgIII at the 5' end of 3' primer, taking care to ensure that the nucleic acid encoding the protein or polypeptide to be expressed is correctly positioned with respect to the poly A signal. The purified fragment obtained from the resulting PCR reaction is digested with PstI, blunt ended with an exonuclease, digested with Bgl II, purified and ligated to pXT1, now containing a poly A signal and digested with BglII.

The ligated product is transfected into mouse NIH 3T3 cells using Lipofectin (Life Technologies, Inc., Grand Island, N.Y.) under conditions outlined in the product specification. Positive transfectants are selected after growing the transfected cells in 600 $\mu$/ml G418 (Sigma, St. Louis, Mis.).

Alternatively, the nucleic acid encoding the protein or polypeptide to be expressed may be cloned into pED6dpc2. The resulting pED6dpc2 constructs may be transfected into a suitable host cell, such as COS 1 cells. Methotrexate resistant cells are selected and expanded. The expressed protein or polypeptide may be isolated, purified, or enriched as described above.

To confirm expression of the desired protein or polypeptide, the proteins or polypeptides produced by cells containing a vector with a nucleic acid insert encoding the protein or polypeptide are compared to those lacking such an insert. The expressed proteins are detected using techniques familiar to those skilled in the art such as Coomassie blue or silver staining or using antibodies against the protein or polypeptide encoded by the nucleic acid insert. Antibodies capable of specifically recognizing the protein of interest may be generated using synthetic 15-mer peptides having a sequence encoded by the appropriate nucleic acid. The synthetic peptides are injected into mice to generate antibody to the polypeptide encoded by the nucleic acid.

If the proteins or polypeptides encoded by the nucleic acid inserts are secreted, medium prepared from the host cells or organisms containing an expression vector which contains a nucleic acid insert encoding the desired protein or polypeptide is compared to medium prepared from the control cells or organism. The presence of a band in medium from the cells containing the nucleic acid insert which is absent from preparations from the control cells indicates that the protein or polypeptide encoded by the nucleic acid insert is being expressed and secreted. Generally, the band corresponding to the protein encoded by the nucleic acid insert will have a mobility near that expected based on the number of amino acids in the open reading frame of the nucleic acid insert. However, the band may have a mobility different than that expected as a result of modifications such as glycosylation, ubiquitination, or enzymatic cleavage.

Alternatively, if the protein expressed from the above expression vectors does not contain sequences directing its secretion, the proteins expressed from host cells containing an expression vector with an insert encoding a secreted protein or portion thereof can be compared to the proteins expressed in control host cells containing the expression vector without an insert. The presence of a band in samples from cells containing the expression vector with an insert which is absent in samples from cells containing the expression vector without an insert indicates that the desired protein or portion thereof is being expressed. Generally, the band will have the mobility expected for the secreted protein or portion thereof. However, the band may have a mobility different than that expected as a result of modifications such as glycosylation, ubiquitination, or enzymatic cleavage.

The expressed protein or polypeptide may be purified, isolated or enriched using a variety of methods. In some methods, the protein or polypeptide may be secreted into the culture medium via a native signal peptide or a heterologous signal peptide operably linked thereto. In some methods, the protein or polypeptide may be linked to a heterologous polypeptide which facilitates its isolation, purification, or enrichment such as a nickel binding polypeptide. The protein or polypeptide may also be obtained by gel electrophoresis, ion exchange chromatography, size chromatography, hplc, salt precipitation, immunoprecipitation, a combination of any of the preceding methods, or any of the isolation, purification, or enrichment techniques familiar to those skilled in the art.

The protein encoded by the nucleic acid insert may also be purified using standard immunochromatography techniques using immunoaffinity chromatography with antibodies directed against the encoded protein or polypeptide as described in more detail below. If antibody production is not possible, the nucleic acid insert encoding the desired protein or polypeptide may be incorporated into expression vectors designed for use in purification schemes employing chimeric polypeptides. In such strategies, the coding sequence of the nucleic acid insert is ligated in frame with the gene encoding the other half of the chimera. The other half of the chimera may be $\beta$-globin or a nickel binding polypeptide. A chromatography matrix having antibody to $\beta$-globin or nickel attached thereto is then used to purify the chimeric protein. Protease cleavage sites may be engineered between the $\beta$-globin gene or the nickel binding polypeptide and the extended cDNA or portion thereof. Thus, the two polypeptides of the chimera may be separated from one another by protease digestion.

One useful expression vector for generating $\beta$-globin chimerics is pSG5 (Stratagene), which encodes rabbit $\beta$-globin. Intron II of the rabbit $\beta$-globin gene facilitates splicing of the expressed transcript, and the polyadenylation signal incorporated into the construct increases the level of expression. These techniques as described are well known to those skilled in the art of molecular biology. Standard methods are published in methods texts such as Davis et al., (*Basic Methods in Molecular Biology*, L. G. Davis, M. D. Dibner, and J. F. Battey, ed., Elsevier Press, NY, 1986), the entire disclosure of which is incorporated herein by reference, and many of the methods are available from Stratagene, Life Technologies, Inc., or Promega. Polypeptide may additionally be produced from the construct using in vitro translation systems such as the In vitro Express™ Translation Kit (Stratagene).

Following expression and purification of the proteins or polypeptides encoded by the nucleic acid inserts, the purified proteins may be tested for the ability to bind to the surface of various cell types as described in Example 23 below. It will be appreciated that a plurality of proteins expressed from these nucleic acid inserts may be included in a panel of proteins to be simultaneously evaluated for the activities specifically described below, as well as other biological roles for which assays for determining activity are available.

EXAMPLE 23

Analysis of Secreted Proteins to Determine Whether They Bind to the Cell Surface The EST-related nucleic acids, fragments of EST-related nucleic acids, positional segments of EST-related nucleic acids, fragments of positional segments of EST-related nucleic acids, nucleic acids encoding the EST-related polypeptides, nucleic acids encoding fragments of the EST-related polypeptides, nucleic acids encoding positional segments of EST-related polypeptides, or nucleic acids encoding fragments of positional segments of EST-related polypeptides are cloned into expression vectors such as those described in Example 22. The encoded proteins or polypeptides are purified, isolated, or enriched as described above. Following purification, isolation, or enrichment, the proteins or polypeptides are labeled using techniques known to those skilled in the art. The labeled proteins or polypeptides are incubated with cells or cell lines derived from a variety of organs or tissues to allow the proteins to bind to any receptor present on the cell surface. Following the incubation, the cells are washed to remove non-specifically bound proteins or polypeptides. The specifically bound labeled proteins or polypeptides are detected by autoradiography. Alternatively, unlabeled proteins or polypeptides may be incubated with the cells and detected with antibodies having a detectable label, such as a fluorescent molecule, attached thereto.

Specificity of cell surface binding may be analyzed by conducting a competition analysis in which various amounts of unlabeled protein or polypeptide are incubated along with the labeled protein or polypeptide. The amount of labeled protein or polypeptide bound to the cell surface decreases as the amount of competitive unlabeled protein or polypeptide increases. As a control, various amounts of an unlabeled protein or polypeptide unrelated to the labeled protein or polypeptide is included in some binding reactions. The amount of labeled protein or polypeptide bound to the cell surface does not decrease in binding reactions containing increasing amounts of unrelated unlabeled protein, indicating that the protein or polypeptide encoded by the nucleic acid binds specifically to the cell surface.

As discussed above, human proteins have been shown to have a number of important physiological effects and, consequently, represent a valuable therapeutic resource. The human proteins or polypeptides made as described above may be evaluated to determine their physiological activities as described below.

EXAMPLE 24

Assaying the Expressed Proteins or Polypeptides for Cytokine Cell Proliferation or Cell Differentiation Activity As discussed above, some human proteins act as cytokines or may affect cellular proliferation or differentiation. Many protein factors discovered to date, including all known cytokines, have exhibited activity in one or more factor dependent cell proliferation assays, and hence the assays serve as a convenient confirmation of cytokine activity. The activity of a protein or polypeptide of the present invention is evidenced by any one of a number of routine factor dependent cell proliferation assays for cell lines including, without limitation, 32D, DA2, DA1G, T10, B9, B9/11, BaF3, MC9/G, $M^+$ (preB $M^+$), 2E8, RB5, DA1, I23, T1165, HT2, CTLL2, TF-1, Mo7c and CMK. The proteins or polypeptides prepared as described above may be evaluated for their ability to regulate T cell or thymocyte proliferation in assays such as those described above or in the following references: Current Protocols in Immunology, Ed. by J. E. Coligan et al., Greene Publishing Associates and Wiley-Interscience; Takai et al. J. Immunol. 137:3494–3500, 1986., Bertagnolli et al. J. Immunol. 145:17061712, 1990., Bertagnolli et al., Cellular Immunology 133:327–341, 1991. Bertagnolli, et al. J. Immunol. 149:3778–3783, 1992; and Bowman et al., J. Immunol. 152:1756–1761, 1994, the entire disclosures of which are incorporated herein by reference.

In addition, numerous assays for cytokine production and/or the proliferation of spleen cells, lymph node cells and thymocytes are known. These include the techniques disclosed in Current Protocols in Immunology. J. E. Coligan et al. Eds., 1:3.12.1–3.12.14, John Wiley and Sons, Toronto. 1994; and Schreiber, R. D. In Current Protocols in Immunology., supra 1: 6.8.1–6.8.8, the entire disclosures of which are incorporated herein by reference The proteins or polypeptides prepared as described above may also be assayed for the ability to regulate the proliferation and differentiation of hematopoietic or lymphopoietic cells. Many assays for such activity are familiar to those skilled in the art, including the assays in the following references: Bottomly et al., In Current Protocols in Immunology., supra. 1: 6.3.1–6.3.12; deVries et al., J. Exp. Med. 173:1205–1211, 1991; Moreau et al., Nature 36:690–692, 1988; Greenberger et al., Proc. Natl. Acad. Sci. U.S.A. 80:2931–2938, 1983; Nordan, R., In Current Protocols in Immunology., supra. 1: 6.6.1–6.6.5; Smith et al., Proc. Natl. Acad. Sci. U.S.A. 83:1857–1861, 1986; Bennett et al in Current Protocols in Immunology supra 1: 6.15.1; and Ciarletta et al In Current Protocols in Immunology. supra 1: 6.13. 1, the entire disclosures of which are incorporated herein by reference.

The proteins or polypeptides prepared as described above may also be assayed for their ability to regulate T-cell responses to antigens. Many assays for such activity are familiar to those skilled in the art, including the assays described in the following references: Chapter 3 (In vitro Assays for Mouse Lymphocyte Function), Chapter 6 (Cytokines and Their Cellular Receptors) and Chapter 7, (Immunologic Studies in Humans) in Current Protocols in Immunology supra; Weinberger et al., Proc. Natl. Acad. Sci. USA 77:6091–6095, 1980; Weinberger et al., Eur. J. Immun. 11:405–411, 1981; Takai et al., J. Immunol. 137:3494–3500, 1986; and Takai et al., J. Immunol. 140:508–512, 1988, the entire disclosure of which is incorporated herein by reference.

Those proteins or polypeptides which exhibit cytokine, cell proliferation, or cell differentiation activity may then be formulated as pharmaceuticals and used to treat clinical conditions in which induction of cell proliferation or differentiation is beneficial. Alternatively, as described in more detail below, nucleic acids encoding these proteins or polypeptides or nucleic acids regulating the expression of these proteins or polypeptides may be introduced into appropriate host cells to increase or decrease the expression of the proteins or polypeptides as desired.

EXAMPLE 25

Assaying the Expressed Proteins or Polypeptides for Activity as Immune System Regulators The proteins or polypeptides prepared as described above may also be evaluated for their effects as immune regulators.

For example, the proteins or polypeptides may be evaluated for their activity to influence thymocyte or splenocyte cytotoxicity. Numerous assays for such activity are familiar to those skilled in the art including the assays described in the following references: Chapter 3 (In vitro Assays for Mouse Lymphocyte Function 3.1–3.19) and Chapter 7 (Immunologic studies in Humans) in *Current Protocols in Immunology*, J. E. Coligan et al. Eds, Greene Publishing Associates and Wiley-Interscience; Hermann et al, *Proc. Natl. Acad. Sci. USA* 78:2488–2492, 1981; Herrmann et al., *J. Immunol.* 128:1968–1974, 1982; Handa et al., *J. Immunol.* 135:1564–1572, 1985; Takai et al, *J. Immunol.* 137:3494–3500, 1986; Takai et al., *J. Immunol.* 140:508–512, 1988; Bowman et al, *J. Virology.* 61:1992–1998; Bertagnolli et al. *Cell. Immunol.* 133:327–341, 1991; and Brown et al., *J. Immunol.* 153:3079–3092, 1994, the entire disclosures of which are incorporated herein by reference.

The proteins or polypeptides prepared as described above may also be evaluated for their effects on T-cell dependent immunoglobulin responses and isotype switching. Numerous assays for such activity are familiar to those skilled in the art, including the assays disclosed in the following references: Maliszewski, *J. Immunol.* 144:3028–3033, 1990, the entire disclosure of which is incorporated herein by reference; and Mond et al in *Current Protocols in Immunology*, 1:3.8.1–3.8.16, supra.

The proteins or polypeptides prepared as described above may also be evaluated for their effect on immune effector cells, including their effect on Th1 cells and cytotoxic lymphocytes. Numerous assays for such activity are familiar to those skilled in the art, including the assays disclosed in the following references: Chapter 3 (In vitro Assays for Mouse Lymphocyte Function 3.1–3.19) and Chapter 7 (Immunologic Studies in Humans) in *Current Protocols in Immunology* supra; Takai et al., *J. Immunol.* 137:3494–3500, 1986; Takcai et al., *J. Immunol.* 140:508–512, 1988; and Bertagnolli et al., *J. Immunol.* 149:3778–3783, 1992, the entire disclosures of which are incorporated herein by reference.

The proteins or polypeptides prepared as described above may also be evaluated for their effect on dendritic cell mediated activation of naive T-cells. Numerous assays for such activity are familiar to those skilled in the art, including the assays disclosed in the following references: Guery et al., *J. Immunol.* 134:536544, 1995; Inaba et al., *J. Exp. Med.* 173:549–559, 1991; Macatonia et al., *J. Immunol.* 154:5071–5079, 1995; Porgador et al *J. Exp. Med.* 182:255–260, 1995; Nair et al., *J. Virol.* 67:40624069, 1993; Huang et al, *Science* 264:961–965, 1994; Macatonia et al *J. Exp. Med* 169:1255–1264, 1989; Bhardwaj et al. *Journal of Clinical Investigation* 94:797–807, 1994; and Inaba et al., *J. Exp. Med* 172:631–640, 1990, the entire disclosures of which are incorporated herein by reference.

The proteins or polypeptides prepared as described above may also be evaluated for their influence on the lifetime of lymphocytes. Numerous assays for such activity are familiar to those skilled in the art, including the assays disclosed in the following references: Darzynliewicz et al., *Cytometry* 13:795–808, 1992; Gorczyca et al., *Leukemia* 7:659670, 1993; Gorczyca et al., *Cancer Res.* 53:1945–1951, 1993; Itoh et al., *Cell* 66:233–243, 1991; Zacharchuk, *J. Immunol.* 145:4037–4045, 1990; Zamai et al., *Cytometry* 14:891–897, 1993; and Gorczyca et al., *Int. J. Oncol.* 1:639–648, 1992, the entire disclosures of which are incorporated herein by reference.

The proteins or polypeptides prepared as described above may also be evaluated for their influence on early steps of T-cell commitment and development. Numerous assays for such activity are familiar to those skilled in the art, including without limitation the assays disclosed in the following references: Antica et al., *Blood* 84:111–117, 1994; Fine et al., *Cell. Immunol.* 155:111–122, 1994; Galy et al., *Blood* 85:2770–2778, 1995; and Toki et al., *Proc. Nat. Acad Sci. USA* 88:7548–7551, 1991, the entire disclosures of which are incorporated herein by reference.

Those proteins or polypeptides which exhibit activity as immune system regulators activity may then be formulated as pharmaceuticals and used to treat clinical conditions in which regulation of immune activity is beneficial. For example, the protein or polypeptide may be useful in the treatment of various immune deficiencies and disorders (including severe combined immunodeficiency), e.g., in regulating (up or down) growth and proliferation of T and/or, B lymphocytes, as well as effecting the cytolytic activity of NK cells and other cell populations. These immune deficiencies may be genetic or be caused by viral (e.g., HIV) as well as bacterial or fungal infections, or may result from autoimmune disorders. More specifically, infectious diseases caused by viral, bacterial, fungal or other infection may be treatable using the protein or polypeptide including infections by HIV, hepatitis viruses, herpesviruses, mycobacteria, Leishmania spp., plamodium, and various fungal infections such as candidiasis. Of course, in this regard, a protein or polypeptide may also be useful where a boost to the immune system generally may be desirable, i.e., in the treatment of cancer.

Alternatively, the proteins or polypeptides prepared as described above may be used in treatment of autoimmune disorders including, for example, connective tissue disease, multiple sclerosis, systemic lupus erythematosus, rheumatoid arthritis, autoimmune pulmonary inflammation, Guillain-Barre syndrome, autoimmune thyroiditis, insulin dependent diabetes mellitis, myasthenia gravis, graft-versus-host disease and autoimmune inflammatory eye disease. Such a protein or polypeptide may also to be useful in the treatment of allergic reactions and conditions, such as asthma (particularly allergic asthma) or other respiratory problems. Other conditions, in which immune suppression is desired (including, for example, organ transplantation), may also be treatable using the protein or polypeptide.

Using the proteins or polypeptides of the invention it may also be possible to regulate immune responses either up or down. Down regulation may involve inhibiting or blocking an immune response already in progress or may involve preventing the induction of an immune response. The functions of activated T-cells may be inhibited by suppressing T cell responses or by inducing specific tolerance in T cells, or both. Immunosuppression of T cell responses is generally an active non-antigen-specific process which requires continuous exposure of the T cells to the suppressive agent Tolerance, which involves inducing non-responsiveness or anergy in T cells, is distinguishable from immunosuppression in that it is generally antigen-specific and persists after the end of exposure to the tolerizing agent. Operationally, tolerance can be demonstrated by the lack of a T cell response upon reexposure to specific antigen in the absence of the tolerizing agent.

Down regulating or preventing one or more antigen functions (including without limitation B lymphocyte antigen functions, such as, for example, B7 costimulation), e.g., preventing high level lymphokine synthesis by activated T cells, will be useful in situations of tissue, skin and organ transplantation and in graft-versus-host disease (GVHD). For example, blockage of T cell function should result in reduced tissue destruction in tissue transplantation. Typically, in tissue tsplants, rejection of the transplant is initiated through its recognition as foreign by T cells, followed by an immune reaction that destroys the transplant. The administration of a molecule which inhibits or blocks interaction of a B7 lymphocyte antigen with its natural ligand(s) on immune cells (such as a soluble, monomeric form of a peptide having B7-2 activity alone or in conjunction with a monomeric form of a peptide having an activity of another B lymphocyte antigen (e.g., B7-1, B7-3) or blocking antibody), prior to transplantation, can lead to the binding of the molecule to the natural ligand(s) on the immune cells without transmitting the corresponding costimulatory signal. Blocking B lymphocyte antigen function in this matter prevents cytokine synthesis by immune cells, such as T cells, and thus acts as an immunosuppressant. Moreover, the lack of costimulation may also be sufficient to anergize the T cells, thereby inducing tolerance in a subject Induction of long-term tolerance by B lymphocyte antigen-blocking reagents may avoid the necessity of repeated administration of these blocking reagents. To achieve sufficient immunosuppression or tolerance in a subject, it may also be necessary to block the function of a combination of B lymphocyte antigens.

The efficacy of particular blocking reagents in preventing organ transplant rejection or GVHD can be assessed using animal models that are predictive of efficacy in humans. Examples of appropriate systems which can be used include allogeneic cardiac grafts in rats and xenogeneic pancreatic islet cell grafts in mice, both of which have been used to examine the immunosuppressive effects of CTLA4Ig fusion proteins in vivo as described in Lenschow et al., *Science* 257:789–792 (1992) and Turka et al., *Proc. Natl. Acad. Sci USA*, 89:11102–11105 (1992), the entire disclosures of which are incorporated herein by reference. In addition, murine models of GVHD (see Paul ed., *Fundamental Immunology*, Raven Press, New York, 1989, pp. 846–847, the entire disclosure of which is incorporated herein by reference) can be used to determine the effect of blocking B lymphocyte antigen function in vivo on the development of that disease.

Blocking antigen function may also be therapeutically useful for treating autoimmune diseases. Many autoimmune disorders are the result of inappropriate activation of T cells that are reactive against self tissue and which promote the production of cytokines and autoantibodies involved in the pathology of the diseases. Preventing the activation of autoreactive T cells may reduce or eliminate disease symptoms. Administration of reagents which block costimulation of T cells by disrupting receptor/ligand interactions of B lymphocyte antigens can be used to inhibit T cell activation and prevent production of autoantibodies or T cell-derived cytolines which potentially involved in the disease process. Additionally, blocking reagents may induce antigen-specific tolerance of autoreactive T cells which could lead to long-term relief from the disease. The efficacy of blocking reagents in preventing or alleviating autoimmune disorders can be determined using a number of well-characterized animal models of human autoimmune diseases. Examples include murine experimental autoimmune encephalitis, systemic lupus erythmatosis in MRL/pr/pr mice or NZB hybrid mice, murine autoimmuno collagen arthritis, diabetes mellitus in OD mice and BB rats, and murine experimental myasthenia gravis (see Paul ed., Fundamental Immunology, Raven Press, New York, 1989, pp. 840–856, the entire disclosure of which is incorporated herein by reference).

Upregulation of an antigen function (preferably a B lymphocyte antigen function), as a means of up regulating immune responses, may also be useful in therapy. Upregulation of immune responses may involve either enhancing an existing immune response or eliciting an initial immune response as shown by the following examples. For instance, enhancing an immune response through stimulating B lymphocyte antigen function may be useful in cases of viral infection. In addition, systemic viral diseases such as influenza, the common cold, and encephalitis might be alleviated by the administration of stimulatory form of B lymphocyte antigens systemically.

Alternatively, antiviral immune responses may be enhanced in an infected patient by removing T cells from the patient, costimulating the T cells in vitro with viral antigen-pulsed APCs either expressing the proteins or polypeptides described above or together with a stimulatory form of the protein or polypeptide and reintroducing the in vitro primed T cells into the patient. The infected cells would now be capable of delivering a costimulatory signal to T cells in vivo, thereby activating the T cells.

In another application, upregulation or enhancement of antigen function (preferably B lymphocyte antigen function) may be useful in the induction of tumor immunity. Tumor cells (e.g., sarcoma, melanoma, lymphoma, leukemia, neuroblastoma, carcinoma) transfected with one of the above-described nucleic acids encoding a protein or polypeptide can be administered to a subject to overcome tumor-specific tolerance in the subject. If desired, the tumor cell can be transfected to express a combination of peptides. For example, tumor cells obtained from a patient can be transfected ex vivo with an expression vector directing the expression of a peptide having B7-2-like activity alone, or in conjunction with a peptide having B7-1-like activity and/or B7-3-like activity. The transfected tumor cells are returned to the patient to result in expression of the peptides on the surface of the transfected cell. Alternatively, gene therapy techniques can be used to target a tumor cell for transfection in vivo.

The presence of the protein or polypeptide encoded by the nucleic acids described above having the activity of a B lymphocyte antigen(s) on the surface of the tumor cell provides the necessary costimulation signal to T cells to induce a T cell mediated immune response against the transfected tumor cells. In addition, tumor cells which lack or which fail to reexpress sufficient amounts of MHC class I or MHC class II molecules can be transfected with nucleic acids encoding all or a portion of (e.g., a cytoplasmic-domain truncated portion) of an MHC class I α chain and $β_2$ microglobulin or an MHC class II α chain and an MHC class II β chain to thereby express MHC class I or MHC class II proteins on the cell surface, respectively. Expression of the appropriate MHC class I or class II molecules in conjunction with a peptide having the activity of a B lymphocyte antigen (e.g., B7-1, B7-2, B7-3) induces a T cell mediated immune response against the transfected tumor cell. Optionally, a nucleic acid encoding an antisense construct which blocks expression of an MHC class II associated protein, such as the invariant chain, can also be cotransfected with a DNA encoding a protein or polypeptide having the activity of a B lymphocyte antigen to promote presentation of tumor associated antigens and induce tumor specific immunity. Thus, the induction of a T cell mediated immune response in a human subject may be sufficient to overcome tumor-specific tolerance in the subject. Alternatively, as described in more detail below, nucleic acids encoding these immune system regulator proteins or polypeptides or nucleic acids regulating the expression of such proteins or polypeptides may be introduced into appropriate host cells to increase or decrease the expression of the proteins as desired.

EXAMPLE 26

Assaying the Expressed Proteins or Polypeptides for Hematopoiesis Regulating Activity The proteins or polypeptides encoded by the nucleic acids described above may also be evaluated for their hematopoiesis regulating activity. For example, the effect of the proteins or polypeptides on embryonic stem cell differentiation may be evaluated. Numerous assays for such activity are familiar to those skilled in the art, including the assays disclosed in the following references: Johansson et al. *Cell. Biol.* 15:141–151, 1995; Keller et al., *Mol. Cell. Biol.* 13:473–486, 1993; and McClanahan et al., *Blood* 81:2903–2915, 1993, the entire disclosures of which are incorporated herein by reference.

The proteins or polypeptides encoded by the nucleic acids described above may also be evaluated for their influence on the lifetime of stem cells and stem cell differentiation. Numerous assays for such activity are familiar to those skilled in the art, including the assays disclosed in the following references: Freshney, M. G. Methylcellulose Colony Forming Assays, in *Culture of Hematopoietic Cells*. R. I. Freshney, et al. Eds. pp. 265–268, Wiley-Liss, Inc., New York, N.Y. 1994; Hirayama et al., *Proc. Natl. Acad. Sci. USA* 89:5907–5911, 1992; McNiece, I. K. and Briddell, R. A. Primitive Hematopoietic Colony Forming Cells with High Proliferative Potential, in *Culture of Hematopoietic Cells*. supra; Neben et al., *Experimental Hematology* 22:353–359, 1994; Ploemacher, R. E. Cobblestone Area Forming Cell Assay, In *Culture of Hematopoietic Cells*. supra; Spooncer, E., Dexter, M. and Allen, T. Long Term Bone Marrow Cultures in the Presence of Stromal Cells, in *Culture of Hematopoietic Cells* supra; and Sutherland, H. J. Long Term Culture Initiating Cell Assay, in *Culture of Hematopoietic Cells*. supra, the entire disclosure of which is incorporated herein by reference.

Those proteins or polypeptides which exhibit heratopoiesis regulatory activity may then be formulated as pharmaceuticals and used to treat clinical conditions in which regulation of hematopoeisis is beneficial. For example, a protein or polypeptide of the present invention may be useful in regulation of hematopoiesis and, consequently, in the treatment of myeloid or lymphoid cell deficiencies. Even marginal biological activity in support of colony forming cells or of factor-dependent cell lines indicates involvement in regulating hematopoiesis, e.g. in supporting the growth and proliferation of erythroid progenitor cells alone or in combination with other cytokines, thereby indicating utility, for example, in treating various anemias or for use in conjunction with irradiation/chemotherapy to stimulate the production of erythroid precursors and/or erythroid cells; in supporting the growth and proliferation of myeloid cells such as granulocytes and monocytes/macrophages (i.e., traditional CSF activity) useful, for example, in conjunction with chemotherapy to prevent or treat consequent myelosuppression; in supporting the growth and proliferation of megakaryocytes and consequently of platelets thereby allowing prevention or treatment of various platelet disorders such as thrombocytopenia, and generally for use in place of or complimentary to platelet transfusions; and/or in supporting the growth and proliferation of hematopoietic stem cells which are capable of maturing to any and all of the above-mentioned hematopoietic cells and therefore find therapeutic utility in various stem cell disorders (such as those usually treated with transplantion, including, without limitation, aplastic anemia and paroxysmal nocturnal hemoglobinuria), as well as in repopulating the stem cell compartment post irradiation/chemotherapy, either in-vivo or ex-vivo (i.e., in conjunction with bone marrow transplantation or with peripheral progenitor cell transplantation (homologous or heterologous)) as normal cells or genetically manipulated for gene therapy. Alternatively, as described in more detail below, nucleic acids encoding these proteins or polypeptides or nucleic acids regulating the expression of these proteins or polypeptides may be introduced into appropriate host cells to increase or decrease the expression of the proteins as desired.

EXAMPLE 27

Assaying the Expressed Proteins or Polypeptides for Regulation of Tissue Growth The proteins or polypeptides encoded by the nucleic acids described above may also be evaluated for their effect on tissue growth. Numerous assays for such activity are familiar to those skilled in the art, including the assays disclosed in International Patent Publication No. WO 95/16035, International Patent Publication No. WO95/05846 and International Patent Publication No. WO91/07491, the entire disclosures of which are incorporated herein by reference.

Assays for wound healing activity include, without limitation, those described in: Winter, *Epidermal Wound Healing*, pps. 71–112 (Maibach, H1 and Rovee, D T, eds.), Year Book Medical Publishers, Inc., Chicago, as modified by Eaglstein and Mertz, J. Invest. Dermatol 71:382–84 (1978), the entire disclosure of which is incorporated herein by reference.

Those proteins or polypeptides which are involved in the regulation of tissue growth may then be formulated as pharmaceuticals and used to treat clinical conditions in which regulation of tissue growth is beneficial. For example, a protein or polypeptide may have utility in compositions used for bone, cartilage, tendon, ligament and/or nerve tissue growth or regeneration, as well as for wound healing and tissue repair and replacement, and in the treatment of burns, incisions and ulcers.

A protein or polypeptide encoded by the nucleic acids described above which induces cartilage and/or bone growth in circumstances where bone is not normally formed, has application in the healing of bone fractures and cartilage damage or defects in humans and other animals. Such a preparation employing a protein or polypeptide of the invention may have prophylactic use in closed as well as open fracture reduction and also in the improved fixation of artificial joints. De novo bone synthesis induced by an osteogenic agent contributes to the repair of congenital, trauma induced, or oncologic resection induced craniofacial defects, and also is useful in cosmetic plastic surgery.

A protein or polypeptide of this invention may also be used in the treatment of periodontal disease, and in other tooth repair processes. Such agents may provide an environment to attract bone-forming cells, stimulate growth of bone-forming cells or induce differentiation of progenitors of bone-forming cells. A protein of the invention may also be useful in the treatment of osteoporosis or osteoarthritis, such as through stimulation of bone and/or cartilage repair or by blocking inflammation or processes of tissue destruction (collagenase activity, osteoclast activity, etc.) mediated by inflammatory processes.

Another category of tissue regeneration activity that may be attributable to the proteins or polypeptides encoded by the nucleic acids described above is tendon/ligament formation. A protein or polypeptide encoded by the nucleic acids described above, which induces tendon/ligament-like tissue or other tissue formation in circumstances where such tissue is not normally formed, has application in the healing of tendon or ligament tears, deformities and other tendon or ligament defects in humans and other animals. Such a preparation employing a tendon/ligament-like tissue inducing protein may have prophylactic use in preventing damage to tendon or ligament tissue, as well as use in the improved fixation of tendon or ligament to bone or other tissues, and in repairing defects to tendon or ligament tissue. De novo tendonaigament-like tissue formation induced by a protein or polypeptide of the present invention contributes to the repair of tendon or ligaments defects of congenital, traumatic or other origin and is also useful in cosmetic plastic surgery for attachment or repair of tendons or ligaments. The proteins or polypeptides of the present invention may provide an environment to attract tendon- or ligament-forming cells, stimulate growth of tendon- or ligament-forming cells, induce differentiation of progenitors of tendon- or ligament-forming cells, or induce growth of tendon/ligament cells or progenitors ex vivo for return in viva to effect tissue repair. The proteins or polypeptides of the invention may also be useful in the treatment of tendinitis, carpal tunnel syndrome and other tendon or ligament defects. The therapeutic compositions may also include an appropriate matrix and/or sequestering agent as a carrier as is well known in the art.

The proteins or polypeptides of the present invention may also be useful for proliferation of neural cells and for regeneration of nerve and brain tissue, i.e., for the treatment of central and peripheral nervous system diseases and neuropathies, as well as mechanical and traumatic disorders, which involve degeneration, death or trauma to neural cells or nerve tissue. More specifically, a protein or polypeptide may be used in the treatment of diseases of the peripheral nervous system, such as peripheral nerve injuries, peripheral neuropathy and localized neuropathies, and central nervous system diseases, such as Alzheimer's, Parkinson's disease, Huntington's disease, amyotrophic lateral sclerosis, and Shy-Drager syndrome. Further conditions which may be treated in accordance with the present invention include mechanical and traumatic disorders, such as spinal cord disorders, head trauma and cerebrovascular diseases such as stroke. Peripheral neuropathies resulting from chemotherapy or other medical therapies may also be treatable using a protein or polypeptide of the invention.

Proteins or polypeptides of the invention may also be useful to promote better or faster closure of non-healing wounds, including without limitation pressure ulcers, ulcers associated with vascular insufficiency, surgical and traumatic wounds, and the like.

It is expected that a protein or polypeptide of the present invention may also exhibit activity for generation or regeneration of other tissues, such as organs (including, for example, pancreas, liver, intestine, kidney, skin, endothelium) muscle (smooth, skeletal or cardiac) and vascular (including vascular endothelium) tissue, or for promoting the growth of cells comprising such tissues. Part of the desired effects may be by inhibition or modulation of fibrotic scarring to allow normal tissue to generate. A protein or polypeptide of the invention may also exhibit angiogenic activity.

A protein or polypeptide of the present invention may also be useful for gut protection or regeneration and treatment of lung or liver fibrosis, reperfusion injury in various tissues, and conditions resulting from systemic cytokine damage.

A protein or polypeptide of the present invention may also be useful for promoting or inhibiting differentiation of tissues described above from precursor tissues or cells; or for inhibiting the growth of tissues described above.

Alternatively, as described in more detail below, nucleic acids encoding tissue growth regulating activity proteins or polypeptides or nucleic acids regulating the expression of such proteins or polypeptides may be introduced into appropriate host cells to increase or decrease the expression of the proteins as desired.

EXAMPLE 28

Assaying the Expressed Proteins or Polypeptides for Regulation of Reproductive Hormones The proteins or polypeptides of the present invention may also be evaluated for their ability to regulate reproductive hormones, such as follicle stimulating hormone. Numerous assays for such activity are familiar to those skilled in the art, including the assays disclosed in the following references: Vale et al., *Endocrinol.* 91:562–572, 1972; Ling et al. *Nature* 321:779–782, 1986; Vale et al., *Nature* 321:776–779, 1986; Mason et al., *Nature* 318:659–663, 1985; Forage et al., *Proc. Natl. Acad. Sci. USA* 83:3091–3095, 1986. Chapter 6.12 in *Current Protocols in Immunology*, J. E. Coligan et al. Eds. Greene Publishing Associates and Wiley-Intersciece ; Taub et al. *J. Clin. Invest.* 95:1370–1376, 1995; Lind et al. *APMIS* 103:140–146, 1995; Muller et al. *Eur. J. Immunol.* 25:1744–1748; Gruber et al. *J. Immunol.* 152:5860–5867, 1994; and Johnston et al., *J. Immunol.* 153:1762–1768, 1994, the entire disclosures of which are incorporated herein by reference.

Those proteins or polypeptides which exhibit activity as reproductive hormones or regulators of cell movement may then be formulated as pharmaceuticals and used to treat clinical conditions in which regulation of reproductive hormones are beneficial. For example, a protein or polypeptide may exhibit activin- or inhibin-related activities. Inhibins are characterized by their ability to inhibit the release of follicle stimulating hormone (FSH), while activins are characterized by their ability to stimulate the release of FSH. Thus, a protein or polypeptide of the present invention, alone or in heterodimers with a member of the inhibin family, may be useful as a contraceptive based on the ability of inhibins to decrease fertility in female mammals and decrease spermatogenesis in male mammals. Administration of sufficient amounts of other inhibins can induce infertility in these mammals. Alternatively, the protein or polypeptide of the invention, as a homodimer or as a heterodimer with other protein subunits of the inhibin-B group, may be useful as a fertility inducing therapeutic, based upon the ability of activin molecules in stimulating FSH release from cells of the anterior pituitary. See, for example, U.S. Pat. No. 4,798, 885. A protein or polypeptide of the invention may also be useful for advancement of the onset of fertility in sexually immature mammals, so as to increase the lifetime reproductive performance of domestic animals such as cows, sheep and pigs.

Alternatively, as described in more detail below, nucleic acids encoding reproductive hormone regulating activity proteins or polypeptides or nucleic acids regulating the expression of such proteins or polypeptides may be introduced into appropriate host cells to increase or decrease the expression of the proteins or polypeptides as desired.

EXAMPLE 29

Assaying the Expressed Proteins or Polypeptides For Chemotactic/Chemokinetic Activity The proteins or polypeptides of the present invention may also be evaluated for chemotactic/chemokinetic activity. For example, a protein or polypeptide of the present invention may have chemotactic or chemokinetic activity (e.g., act as a chemokine) for mammalian cells, including, for example, monocytes, fibroblasts, neutrophils, T-cells, mast cells, eosinophils, epithelial and/or endothelial cells. Chemotactic and chemokinetic proteins or polypeptides can be used to mobilize or attract a desired cell population to a desired site of action. Chemotactic or chemokinetic proteins or polypeptides provide particular advantages in treatment of wounds and other trauma to tissues, as well as in treatment of localized infections. For example, attraction of lymphocytes, monocytes or neutrophils to tumors or sites of infection may result in improved immune responses against the tumor or infecting agent.

A protein or polypeptide has chemotactic activity for a particular cell population if it can stimulate, directly or indirectly, the directed orientation or movement of such cell population. Preferably, the protein or polypeptide has the ability to directly stimulate directed movement of cells. Whether a particular protein or polypeptide has chemotactic activity for a population of cells can be readily determined by employing such protein or polypeptide in any known assay for cell chemotaxis.

The activity of a protein or polypeptide of the invention may, among other means, be measured by the following methods:

Assays for chemotactic activity (which will identify proteins or polypeptides that induce or prevent chemotaxis) consist of assays that measure the ability of a protein or polypeptide to induce the migration of cells across a membrane as well as the ability of a protein or polypeptide to induce the adhesion of one cell population to another cell population. Suitable assays for movement and adhesion include, without limitation, those described in: *Current Protocols in Immunology*, Ed by J. E. Coligan, A. M. Kruisbeek, D. H. Margulies, E. M. Shevach, W. Strober, Pub. Greene Publishing Associates and Wiley Interscience, Chapter 6.12: 6.12.1–6.12.28; Taub et al. *J. Clin. Invest.* 95:1370–1376, 1995; Lind et al. *APMIS* 103:140–146, 1995; Mueller et al., *Eur. J. Immunol.* 25:1744–1748; Gruber et al. *J. Immunol.* 152:5860–5867, 1994; and Johnston et al. *J. Immunol.*, 153:1762–1768, 1994, the entire disclosures of which are incorporated herein by reference.

EXAMPLE 30

Assaying the Expressed Proteins or Polypeptides for Regulation of Blood Clotting The proteins or polypeptides of the present invention may also be evaluated for their effects on blood clotting. Numerous assays for such activity are familiar to those skilled in the art, including the assays disclosed in the following references: Linet et al., *J. Clin. Pharmacol.* 26:131–140, 1986; Burdick et al., *Thrombosis Res.* 45:413419, 1987; Humphrey et al., *Fibrinolysis* 5:71–79 (1991); and Schaub, *Prostaglandins* 35:467474, 1988, the entire disclosures of which are incorporated herein by reference.

Those proteins or polypeptides which are involved in the regulation of blood clotting may then be formulated as pharmaceuticals and used to treat clinical conditions in which regulation of blood clotting is beneficial. For example, a protein or polypeptide of the invention may also exhibit hemostatic or thrombolytic activity. As a result, such a protein or polypeptide is expected to be useful in treatment of various coagulations disorders (including hereditary disorders, such as hemophilias) or to enhance coagulation and other hemostatic events in treating wounds resulting from trauma, surgery or other causes. A protein or polypeptide of the invention may also be useful for dissolving or inhibiting formation of thromboses and for treatment and prevention of conditions resulting therefrom (such as infarction of cardiac and central nervous system vessels (e.g., stroke)). Alternatively, as described in more detail below, nucleic acids encoding blood clotting activity proteins or polypeptides or nucleic acids regulating the expression of such proteins or polypeptides may be introduced into appropriate host cells to increase or decrease the expression of the proteins or polypeptides as desired.

EXAMPLE 31

Assaying the Expressed Proteins or Polypeptides for Involvement in Receptor/Ligand Interactions The proteins or polypeptides of the present invention may also be evaluated for their involvement in receptor/ligand interactions. Numerous assays for such involvement are familiar to those skilled in the art, including the assays disclosed in the following references: Chapter 7. 7.28.1–7.28.22) in *Current Protocols in Immunology*, J. E. Coligan et al. Eds. Greene Publishing Associates and Wiley-Interscience; Takai et al., *Proc. Natl. Acad. Sci. USA* 84:6864–6868, 1987; Bierer et al., *J. Exp. Med.* 168:1145–1156, 1988; Rosenstein et al., *J. Exp. Med.* 169:149–160, 1989; Stoltenborg et al., *J. Immunol. Methods* 175:59–68, 1994; Stitt et al., *Cell* 80:661–670, 1995; and Gyuris et al., *Cell* 75:791–803, 1993, the entire disclosures of which are incorporated herein by reference.

For example, the proteins or polypeptides of the present invention may also demonstrate activity as receptors, receptor ligands or inhibitors or agonists of receptor/ligand interactions. Examples of such receptors and ligands include, without limitation, cytokine receptors and their ligands, receptor kinases and their ligands, receptor phosphatases and their ligands, receptors involved in cell-cell interactions and their ligands (including without limitation, cellular adhesion molecules (such as selectins, integrins and their ligands) and receptor/ligand pairs involved in antigen presentation, antigen recognition and development of cellular and humoral immune responses). Receptors and ligands are also useful for screening of potential peptide or small molecule inhibitors of the relevant receptor/ligand interaction. A protein or polypeptide of the present invention (including, without limitation, fragments of receptors and ligands) may be useful as inhibitors of receptor/ligand interactions. Alternatively, as described in more detail below, nucleic acids encoding proteins or polypeptides involved in receptor/ligand interactions or nucleic acids regulating the expression of such proteins or polypeptides may be introduced into appropriate host cells to increase or decrease the expression of the proteins or polypeptides as desired.

EXAMPLE 32

Assaying the Proteins or Polypeptides for Anti-Inflammatory Activity

The proteins or polypeptides of the present invention may also be evaluated for anti-inflammatory activity. The anti-inflammatory activity may be achieved by providing a stimulus to cells involved in the inflammatory response, by inhibiting or promoting cell-cell interactions (such as, for example, cell adhesion), by inhibiting or promoting chemotaxis of cells involved in the inflammatory process, inhibiting or promoting cell extravasation, or by stimulating or suppressing production of other factors which more directly inhibit or promote an inflammatory response. Proteins or polypeptides exhibiting such activities can be used to treat inflammatory conditions including chronic or acute conditions, including without limitation inflammation associated with infection (such as septic shock, sepsis or systemic inflammatory response syndrome), ischemia-reperfusioninury, endotoxin lethality, arthritis, complement-mediated hyperacute rejection, nephritis, cytokine- or chemokine-induced lung injury, inflammatory bowel disease, Crohn's disease or resulting from over production of cytokines such as TNF or IL-1. Proteins or polypeptides of the invention may also be useful to treat anaphylaxis and hypersensitivity to an antigenic substance or material. Alternatively, as described in more detail below, nucleic acids encoding anti-inflammatory activity proteins or polypeptides or nucleic acids regulating the expression of such proteins or polypeptides may be introduced into appropriate host cells to increase or decrease the expression of the proteins or polypeptides as desired.

EXAMPLE 33

Assaying the Expressed Proteins or Polypeptides for Tumor Inhibition Activity

The proteins or polypeptides of the present invention may also be evaluated for tumor inhibition activity. In addition to the activities described above for immunological treatment or prevention of tumors, a protein or polypeptide of the invention may exhibit other anti-tumor activities. A protein or polypeptide may inhibit tumor growth directly or indirectly (such as, for example, via ADCC). A protein or polypeptide may exhibit its tumor inhibitory activity by acting on tumor tissue or tumor precursor tissue, by inhibiting formation of tissues necessary to support tumor growth (such as, for example, by inhibiting angiogenesis), by causing production of other factors, agents or cell types which inhibit tumor growth, or by suppressing, eliminating or inhibiting factors, agents or cell types which promote tumor growth. . Alternatively, as described in more detail below, nucleic acids encoding proteins or polypeptides with tumor inhibition activity or nucleic acids regulating the expression of such proteins or polypeptides may be introduced into appropriate host cells to increase or decrease the expression of the proteins or polypeptides as desired.

A protein or polypeptide of the invention may also exhibit one or more of the following additional activities or effects: inhibiting the growth, infection or function of, or Inclining, infectious agents, including, without limitation, bacteria, viruses, fungi and other parasites; effecting (suppressing or enhancing) bodily characteristics, including, without limitation, height, weight, hair color, eye color, skin, fat to lean ratio or other tissue pigmentation, or organ or body part size or shape (such as, for example, breast augmentation or diminution, change in bone form or shape); effecting biorhythms or circadian cycles or rhythms; effecting the fertility of male or female subjects; effecting the metabolism, catabolism, anabolism, processing, utilization, storage or elimination of dietary fat, lipid, protein, carbohydrate, vitamins, minerals, cofactors or other nutritional factors or component(s); effecting behaviora characteristics, including, without limitation, appetite, libido, stress, cognition (including cognitive disorders), depression (including depressive disorders) and violent behaviors; providing analgesic effects or other pain reducing effects; promoting differentiation and growth of embryonic stem cells in lineages other than hematopoietic lineages; hormonal or endocrine activity; in the case of enzymes, correcting deficiencies of the enzyme and treating deficiency-related diseases; treatment of hyperproliferative disorders (such as, for example, psoriasis); immunoglobulin-like activity (such as, for example, the ability to bind antigens or complement); and the ability to act as an antigen in a vaccine composition to raise an immune response against such protein or another material or entity which is cross-reactive with such protein. Alternatively, as described in more detail below, nucleic acids encoding proteins or polypeptides involved in any of the above mentioned activities or nucleic acids regulating the expression of such proteins may be introduced into appropriate host cells to increase or decrease the expression of the proteins or polypeptides as desired.

EXAMPLE 34

Identification of Proteins or Polypeptides which Interact with Proteins or Polypeptides of the Present Invention Proteins or polypeptides which interact with the proteins or polypeptides of the present invention, such as receptor proteins, may be identified using two hybrid systems such as the Matchmaker Two Hybrid System 2 (Catalog No. K1604-1, Clontech). As described in the manual accompanying the kit, nucleic acids encoding the proteins or polypeptides of the present invention, are inserted into an expression vector such that they are in frame with DNA encoding the DNA binding domain of the yeast transcriptional activator GAL4. cDNAs in a cDNA library which encode proteins or polypeptides which might interact with the proteins or polypeptides of the present invention are inserted into a second expression vector such that they are in frame with DNA encoding the activation domain of GAL4 . The two expression plasmids are transformed into yeast and the yeast are plated on selection medium which selects for expression of selectable markers on each of the expression vectors as well as GAL4 dependent expression of the HIS3 gene. Transformants capable of growing on medium lacking histidine are screened for GAL4 dependent lacZ expression. Those cells which are positive in both the histidine selection and the lacZ assay contain plasmids encoding proteins or polypeptides which interact with the proteins or polypeptides of the present invention.

Alternatively, the system described in Lustig et al., *Methods in Enzymology* 283: 83–99 (1997), the entire disclosure of which is incorporated herein by reference, may be used for identifying molecules which interact with the proteins or polypeptides of the present invention. In such systems, in vitro transcription reactions are performed on a pool of vectors containing nucleic acid inserts which encode the proteins or polypeptides of the present invention. The nucleic acid inserts are cloned downstream of a promoter which drives in vitro transcription. The resulting pools of mRNAs are introduced into *Xenopus laevis* oocytes. The oocytes are then assayed for a desired activity.

Alternatively, the pooled in vitro transcription products produced as described above may be translated in vitro. The pooled in vitro translation products can be assayed for a desired activity or for interaction with a known protein or polypeptide.

Proteins, polypeptides or other molecules interacting with proteins or polypeptides of the present invention can be found by a variety of additional techniques. In one method, affinity columns containing the protein or polypeptide of the present invention can be constructed. In some versions, of this method the affinity column contains chimeric proteins in which the protein or polypeptide of the present invention is fused to glutathione S-transferase. A mixture of cellular proteins or pool of expressed proteins as described above and is applied to the affinity column. Molecules interacting with the protein or polypeptide attached to the column can then be isolated and analyzed on 2-D electrophoresis gel as described in Ramunsen et al. *Electrophoresis*, 18, 588–598 (1997). Alternatively, the molecules retained on the affinity column can be purified by electrophoresis based methods and sequenced. The same method can be used to isolate antibodies, to screen phage display products, or to screen phage display human antibodies.

Molecules interacting with the proteins or polypeptides of the present invention can also be screened by using an Optical Biosensor as described in Edwards & Leatherbarrow, *Analytical Biochemistry*, 246, 1–6 (1997), the entire disclosure of which is incorporated herein by reference. The main advantage of the method is that it allows the determination of the association rate between the protein or polypeptide and other interacting molecules. Thus, it is possible to specifically select interacting molecules with a high or low association rate. Typically a target molecule is linked to the sensor surface (through a carboxymethyl dextran matrix) and a sample of test molecules is placed in contact with the target molecules. The binding of a test molecule to the target molecule causes a change in the refractive index and/or thickness. This change is detected by the Biosensor provided it occurs in the evanescent field (which extends a few hundred nanometers from the sensor surface). In these screening assays, the target molecule can be one of the proteins or polypeptides of the present invention and the test sample can be a collection of proteins, polypeptides or other molecules extracted from tissues or cells, a pool of expressed proteins, combinatorial peptide and/or chemical libraries, or phage displayed peptides. The tissues or cells from which the test molecules are extracted can originate from any species.

In other methods, a target protein or polypeptide is immobilized and the test population is a collection of unique proteins or polypeptides of the present invention.

To study the interaction of the proteins or polypeptides of the present invention with drugs, the microdialysis coupled to HPLC method described by Wang et al., *Chromalographia*, 44, 205–208(1997) or the affinity capillary electrophoresis method described by Busch et al., *J. Chromatogr.* 777:311–328 (1997), the entire disclosures of which are incorporated herein by reference, can be used.

The system described in U.S. Pat. No. 5,654,150 may also be used to identify molecules which interact with the proteins or polypeptides of the present invention. In this system, pools of nucleic acids encoding the proteins or polypeptides of the present invention are transcribed and translated in vitro and the reaction products are assayed for interaction with a known polypeptide or antibody.

It will be appreciated by those skilled in the art that the proteins or polypeptides of the present invention may be assayed for numerous activities in addition to those specifically enumerated above. For example, the expressed proteins or polypeptides may be evaluated for applications involving control and regulation of inflammation, tumor proliferation or metastasis, infection, or other clinical conditions. In addition, the proteins or polypeptides may be useful as nutritional agents or cosmetic agents.

The proteins or polypeptides of the present invention may be used to generate antibodies capable of specifically binding to the proteins or polypeptides of the present invention. The antibodies may be monoclonal antibodies or polyclonal antibodies. As used herein, "antibody" refers to a polypeptide or group of polypeptides which are comprised of at least one binding domain, where a binding domain is formed from the folding of variable domains of an antibody molecule to form three-dimensional binding spaces with an internal surface shape and charge distribution complementary to the features of an antigenic determinant of an antigen., which allows an immunological reaction with the antigen. Antibodies include recombinant proteins comprising the binding domains, as wells as fragments, including Fab, Fab', $F(ab)_2$, and $F(ab')_2$ fragments.

As used herein, an "antigenic determinant" is the portion of an antigen molecule, that determines the specificity of the antigen-antibody reaction. An "epitope" refers to an antigenic determinant of a polypeptide. An epitope can comprise as few as 3 amino acids in a spatial conformation which is unique to the epitope. Generally an epitope consists of at least 6 such amino acids, and more usually at least 8–10 such amino acids. Methods for determining the amino acids which make up an epitope include x-ray crystallography, 2-dimensional nuclear magnetic resonance, and epitope mapping e.g. the Pepscan method described by H. Mario Geysen et al. 1984. Proc. Natl. Acad. Sci. U.S.A. 81:3998–4002; PCT Publication No. WO 84/03564; and PCT Publication No. WO 84/03506, the entire disclosures of which are incorporated herein by reference.

In some embodiments, the antibodies may be capable of specifically binding to a protein or polypeptide encoded by EST-related nucleic acids, fragments of EST-related nucleic acids, positional segments of EST-related nucleic acids or fragments of positional segments of EST-related nucleic acids. In some embodiments, the antibody may be capable of binding an antigenic determinant or an epitope in a protein or polypeptide encoded by EST-related nucleic acids, fragments of EST-related nucleic acids, positional segments of EST-related nucleic acids or fragments of positional segments of EST-related nucleic acids.

In other embodiments, the antibodies may be capable of specifically binding to an EST-related polypeptide, fragment of an EST-related polypeptide, positional segment of an EST-related polypeptide or fragment of a positional segment of an EST-related polypeptide. In some embodiments, the antibody may be capable of binding an antigenic determinant or an epitope in an EST-related polypeptide, fragment of an EST-related polypeptide, positional segment of an EST-related polypeptide or fragment of a positional segment of an EST-related polypeptide.

In the case of secreted proteins, the antibodies may be capable of binding a full-length protein encoded by a nucleic acid of the present invention, a mature protein (i.e. the protein generated by cleavage of the signal peptide) encoded by a nucleic acid of the present invention, or a signal peptide encoded by a nucleic acid of the present invention.

EXAMPLE 35

Production of an Antibody to a Human Polypeptide or Protein

The above described EST-related nucleic acids, fragments of EST-related nucleic acids, positional segments of EST-related nucleic acids or fragments of positional segments of EST-related nucleic acids or nucleic acids encoding EST-related polypeptides, fragments of EST-related polypeptides, positional segments of EST-related polypeptides or fragments of positional segments of EST-related polypeptides are operably linked to promoters and introduced into cells as described above.

In the case of secreted proteins, nucleic acids encoding the full protein (i.e. the mature protein and the signal peptide), nucleic acids encoding the mature protein (i.e. the protein generated by cleavage of the signal peptide), or nucleic acids encoding the signal peptide are operably linked to promoters and introduced into cells as described above.

The encoded proteins or polypeptides are then substantially purified or isolated as described above. The concentration of protein in the final preparation is adjusted, for example, by concentration on an Amicon filter device, to the level of a few µg/ml. Monoclonal or polyclonal antibody to the protein or polypeptide can then be prepared as follows:

1. Monoclonal Antibody Production by Hybridoma Fusion

Monoclonal antibody to epitopes of any of the proteins or polypeptides identified and isolated as described can be prepared from murine hybridomas according to the classical method of Kohler, and Milstein, *Nature* 256:495 (1975), the entire disclosure of which is incorporated herein by reference, or derivative methods thereof. Briefly, a mouse is repetitively inoculated with a few micrograms of the selected protein or peptides derived therefrom over a period of a few weeks. The mouse is then sacrificed, and the antibody producing cells of the spleen isolated. The spleen cells are fused by means of polyethylene glycol with mouse myeloma cells, and the excess unfused cells destroyed by growth of the system on selective media comprising aminopterin (HAT media). The successfully fused cells are diluted and aliquots of the dilution placed in wells of a microtiter plate where growth of the culture is continued. Antibody-producing clones are identified by detection of antibody in the supernatant fluid of the wells by immunoassay procedures, such as Elisa, as originally described by Engvall, *Meth. Enzymol.* 70:419 (1980), the entire disclosure of which is incorporated herein by reference. Selected positive clones can be expanded and their monoclonal antibody product harvested for use. Detailed procedures for monoclonal antibody production are described in Davis, L. et al. in *Basic Methods in Molecular Biology* Elsevier, New York. Section 21-2, the entire disclosure of which is incorporated herein by reference.

2. Polyclonal Antibody Production by Immunization

Polyclonal antiserum containing antibodies to heterogenous epitopes of a single protein or polypeptide can be prepared by immunizing suitable animals with the expressed protein or peptides derived therefrom, which can be unmodified or modified to enhance immunogenicity. Effective polyclonal antibody production is affected by many factors related both to the antigen and the host species. For example, small molecules tend to be less immunogenic than others and may require the use of carriers and adjuvant. Also, host animals response vary depending on site of inoculations and doses, with both inadequate or excessive doses of antigen resulting in low titer antisera. Small doses (ng level) of antigen administered at multiple intradermal sites appears to be most reliable. An effective immunization protocol for rabbits can be found in Vaitukaitis. et al. *J. Clin. Endocrinol. Metab.* 33:988–991 (1971), the entire disclosure of which is incorporated herein by reference.

Booster injections can be given at regular intervals, and antiserum harvested when antibody titer thereof, as determined semi-quantitatively, for example, by double immunodiffusion in agar against known concentrations of the antigen, begins to fall. See, for example, Ouchterlony, et al., Chap. 19 in: *Handbook of Experimental Immunology* D. Wier (ed) Blackwell (1973), the entire disclosure of which is incorporated herein by reference. Plateau concentration of antibody is usually in the range of 0.1 to 0.2 mg/ml of serum (about 12 µM). Affinity of the antisera for the antigen is determined by preparing competitive binding curves, as described, for example, by Fisher, D., Chap. 42 in: *Manual of Clinical Immunology*, 2d Ed. (Rose and Friedman, Eds.) Amer. Soc. For Microbiol., Washington, D.C. (1980), the entire disclosure of which is incorporated herein by reference.

Antibody preparations prepared according to either of the above protocols are useful in a variety of contexts. In particular, the antibodies may be used in immunoaffinity chromatography techniques such as those described below to facilitate large scale isolation, purification, or enrichment of the proteins or polypeptides encoded by EST-related nucleic acids, positional segments of EST-related nucleic acids or fragments of positional segments of EST-related nucleic acids or for the isolation, purification or enrichment of EST-related polypeptides, fragments of EST-related polypeptides, positional segments of EST-related polypeptides or fragments of positional segments of EST-related polypeptides.

In the case of secreted proteins, the antibodies may be used for the isolation, purification, or enrichment of the full protein (i.e. the mature protein and the signal peptide), the mature protein (i.e. the protein generated by cleavage of the signal peptide), or the signal peptide are operably linked to promoters and introduced into cells as described above.

Additionally, the antibodies may be used in immunoaffinity chromatography techniques such as those described below to isolate, purify, or enrich polypeptides which have been linked to the proteins or polypeptides encoded by EST-related nucleic acids, positional segments of EST-related nucleic acids or fragments of positional segments of EST-related nucleic acids or to isolate, purify, or enrich EST-related polypeptides, fragments of EST-related polypeptides, positional segments of EST-related polypeptides or fragments of positional segments of EST-related polypeptides.

The antibodies may also be used to determine the cellular localization of polypeptides encoded by the proteins or polypeptides encoded by EST-related nucleic acids, positional segments of EST-related nucleic acids or fragments of positional segments of EST-related nucleic acids or the cellular localization of EST-related polypeptides, fragments of EST-related polypeptides, positional segments of EST-related polypeptides or fragments of positional segments of EST-related polypeptides.

In addition, the antibodies may also be used to determine the cellular localization of polypeptides which have been linked to the proteins or polypeptides encoded by EST-related nucleic acids, positional segments of EST-related nucleic acids or fragments of positional segments of EST-related nucleic acids or polypeptides which have been linked to EST-related polypeptides, fragments of EST-related polypeptides, positional segments of EST-related polypeptides or fragments of positional segments of EST-related polypeptides .

The antibodies may also be used in quantitative immunoassays which determine concentrations of antigen-bearing substances in biological samples; they may also used semi-quantitatively or qualitatively to identify the presence of antigen in a biological sample or to identify the type of tissue present in a biological sample. The antibodies may also be used in therapeutic compositions for killing cells expressing the protein or reducing the levels of the protein in the body.

VI Use of 5'ESTs or Consensus Contigated 5' ESTs or Sequences Obtainable Therefrom or Portions Thereof as Reagents The EST-related nucleic acids, positional segments of EST-related nucleic acids or fragments of positional segments of EST-related nucleic acids may be used as reagents in isolation procedures, diagnostic assays, and forensic procedures. For example, sequences from the EST-related nucleic acids, positional segments of EST-related nucleic acids or fragments of positional segments of EST-related nucleic acids, may be detectably labeled and used as probes to isolate other sequences capable of hybridizing to them. In addition, the EST-related nucleic acids, positional segments of EST-related nucleic acids or fragments of positional segments of EST-related nucleic acids may be used to design PCR primers to be used in isolation, diagnostic, or forensic procedures.

1. Use of EST-Related Nucleic Acids, Positional Segments of EST-Related Nucleic Acids or Fragments of Positional Segments of EST-Related Nucleic Acids in Isolation, Diagnostic and Forensic Procedures

EXAMPLE 36

Preparation of PCR Primers and Amplification of DNA

The EST-related nucleic acids, positional segments of EST-related nucleic acids or fragments of positional segments of EST-related nucleic acids may be used to prepare PCR primers for a variety of applications, including isolation procedures for cloning nucleic acids capable of hybridizing to such sequences, diagnostic techniques and forensic techniques. In some embodiments, the PCR primers at least 10, 15, 18, 20, 23, 25, 28, 30, 40, or 50 nucleotides in length. In some embodiments, the PCR primers may be more than 30 bases in length. It is preferred that the primer pairs have approximately the same GIC ratio, so that melting temperatures are approximately the same. A variety of PCR techniques are familiar to those skilled in the art. For a review of PCR technology, see Molecular Cloning to Genetic Engineering White, B. A. Ed. in *Methods in Molecular Biology* 67: Humana Press, Totowa 1997, the entire disclosure of which is incorporated herein by reference. In each of these PCR procedures, PCR primers on either side of the nucleic acid sequences to be amplified are added to a suitably prepared nucleic acid sample along with dNTPs and a thermostable polymerase such as Taq polymerase, Pfu polymerase, or Vent polymerase. The nucleic acid in the sample is denatured and the PCR primers are specifically hybridized to complementary nucleic acid sequences in the sample. The hybridized primers are extended. Thereafter, another cycle of denaturation, hybridization, and extension is initiated. The cycles are repeated multiple times to produce an amplified fragment containing the nucleic acid sequence between the primer sites.

EXAMPLE 37

Use of the EST-Related Nucleic Acids Positional Segments of EST-Related Nucleic Acids or Fragments of Positional Segments of EST-Related Nucleic Acids as Probes Probes derived from EST-related nucleic acids, positional segments of EST-related nucleic acids or fragments of positional segments of EST-related nucleic acids may be labeled with detectable labels familiar to those skilled in the art, including radioisotopes and non-radioactive labels, to provide a detectable probe. The detectable probe may be single stranded or double stranded and may be made using techniques known in the art, including in vitro transcription, nick translation, or kinase reactions. A nucleic acid sample containing a sequence capable of hybridizing to the labeled probe is contacted with the labeled probe. If the nucleic acid in the sample is double stranded, it may be denatured prior to contacting the probe. In some applications, the nucleic acid sample may be immobilized on a surface such as a nitrocellulose or nylon membrane. The nucleic acid sample may comprise nucleic acids obtained from a variety of sources, including genomic DNA, cDNA libraries, RNA, or tissue samples.

Procedures used to detect the presence of nucleic acids capable of hybridizing to the detectable probe include well known techniques such as Southern blotting, Northern blotting, dot blotting, colony hybridization, and plaque hybridization. In some applications, the nucleic acid capable of hybridizing to the labeled probe may be cloned into vectors such as expression vectors, sequencing vectors, or in vitro transcription vectors to facilitate the characterization and expression of the hybridizing nucleic acids in the sample. For example, such techniques may be used to isolate and clone sequences in a genomic library or cDNA library which are capable of hybridizing to the detectable probe as described in Example 20 above.

PCR primers made as described in Example 36 above may be used in forensic analyses, such as the DNA fingerprinting techniques described in Examples 38–42 below. Such analyses may utilize detectable probes or primers based on the sequences of the EST-related nucleic acids, positional segments of EST-related nucleic acids or fragments of positional segments of EST-related nucleic acids.

EXAMPLE 38

Forensic Matching by DNA Sequencing

In one exemplary method, DNA samples are isolated from forensic specimens of, for example, hair, semen, blood or skin cells by conventional methods. A panel of PCR primers based on a number of the EST-related nucleic acids, positional segments of EST-related nucleic acids or fragments of positional segments of EST-related nucleic acids is then utilized in accordance with Example 36 to amplify DNA of approximately 100–200 bases in length from the forensic specimen. Corresponding sequences are obtained from a test subject. Each of these identification DNAs is then sequenced using standard techniques, and a simple database comparison determines the differences, if any, between the sequences from the subject and those from the sample. Statistically significant differences between the suspect's DNA sequences and those from the sample conclusively prove a lack of identity. This lack of identity can be proven, for example, with only one sequence. Identity, on the other hand, should be demonstrated with a large number of sequences, all matching. Preferably, a minimum of 50 statistically identical sequences of 100 bases in length are used to prove identity between the suspect and the sample.

EXAMPLE 39

Positive Identification by DNA Sequencing

The technique outlined in the previous example may also be used on a larger scale to provide a unique fingerprint-type identification of any individual. In this technique, primers are prepared from a large number of EST-related nucleic acids, positional segments of EST-related nucleic acids or fragments of positional segments of EST-related nucleic acids. Preferably, 20 to 50 different primers are used. These primers are used to obtain a corresponding number of PCR-generated DNA segments from the individual in question in accordance with Example 34. Each of these DNA segments is sequenced, using the methods set forth in Example 36. The database of sequences generated through this procedure uniquely identifies the individual from whom the sequences were obtained. The same panel of primers may then be used at any later time to absolutely correlate tissue or other biological specimen with that individual.

EXAMPLE 40

Southern Blot Forensic Identification

The procedure of Example 38 is repeated to obtain a panel of at least 10 amplified sequences from an individual and a specimen. Preferably, the panel contains at least 50 amplified sequences. More preferably, the panel contains 100 amplified sequences. In some embodiments, the panel contains 200 amplified sequences. This PCR-generated DNA is then digested with one or a combination of, preferably, four base specific restriction enzymes. Such enzymes are commercially available and known to those of skill in the art. After digestion, the resultant gene fragments are size separated in multiple duplicate wells on an agarose gel and transferred to nitrocellulose using Southern blotting techniques well known to those with skill in the art. For a review of Southern blotting see Davis et al. (Basic Methods in Molecular Biology, 1986, Elsevier Press. pp 62–65), the entire disclosure of which is incorporated herein by reference.

A panel of probes based on the sequences of the EST-related nucleic acids, positional segments of EST-related nucleic acids or fragments of positional segments of EST-related nucleic acids are radioactively or colorimetrically labeled using methods known in the art, such as nick translation or end labeling, and hybridized to the Southern blot using techniques known in the art (Davis et al., supra). Preferably, the probe is at least 10, 12, 15, 18, 20, 25, 28, 30, 35, 40, 50, 75, 100, 150, 200, 300, 400 or 500 nucleotides in length. Preferably, the probes are at least 10, 12, 15, 18, 20, 25, 28, 30, 35, 40, 50, 75, 100, 150, 200, 300, 400 or 500 nucleotides in length. In some embodiments, the probes are oligonucleotides which are 40 nucleotides in length or less.

Preferably, at least 5 to 10 of these labeled probes are used, and more preferably at least about 20 or 30 are used to provide a unique pattern. The resultant bands appearing from the hybridization of a large sample of EST-related nucleic acids, positional segments of EST-related nucleic acids or fragments of positional segments of EST-related nucleic acids will be a unique identifier. Since the restriction enzyme cleavage will be different for every individual, the band pattern on the Southern blot will also be unique. Increasing the number of probes will provide a statistically higher level of confidence in the identification since there will be an increased number of sets of bands used for identification.

EXAMPLE 41

Dot Blot Identification Procedure

Another technique for identifying individuals using the EST-related nucleic acids, positional segments of EST-related nucleic acids or fragments of positional segments of EST-related nucleic acids disclosed herein utilizes a dot blot hybridization technique.

Genomic DNA is isolated from nuclei of subject to be identified. Probes are prepared that correspond to at least 10, preferably 50 sequences from the EST-related nucleic acids, positional segments of EST-related nucleic acids or fragments of positional segments of EST-related nucleic acids. The probes are used to hybridize to the genomic DNA through conditions known to those in the art. The oligonucleotides are end labeled with P2 using polynucleotide kinase (Pharmacia). Dot Blots are created by spotting the genomic DNA onto nitrocellulose or the like using a vacuum dot blot manifold (BioRad, Richmond Calif.). The nitrocellulose filter containing the genomic sequences is baked or UV linked to the filter, prehybridized and hybridized with labeled probe using techniques known in the art (Davis et al., supra). The $^{32}$p labeled-DNA fragments are sequentially hybridized with successively stringent conditions to detect minimal differences between the 30 bp sequence and the DNA. Tetramethylammonium chloride is useful for identifying clones containing small numbers of nucleotide mismatches (Wood et al., Proc. Natl. Acad. Sci. USA 82(6): 1585–1588 (1985), the entire disclosure of which is incorporated herein by reference). A unique pattern of dots distinguishes one individual from another individual.

EST-related nucleic acids, positional segments of EST-related nucleic acids or fragments of positional segments of EST-related nucleic acids can be used as probes in the following alternative fingerprinting technique. In some embodiments, the probes are oligonucleotides which are 40 nucleotides in length or less.

Preferably, a plurality of probes having sequences from different EST-related nucleic acids, positional segments of EST-related nucleic acids or fragments of positional segments of EST-related nucleic acids are used in the alternative fingerprinting technique. Example 42 below provides a representative alternative fingerprinting procedure in which the probes are derived from EST-related nucleic acids, positional segments of EST-related nucleic acids or fragments of positional segments of EST-related nucleic acids.

EXAMPLE 42

Alternative "Fingerprint" Identification Technique

Oligonucleotides are prepared from a large number, e.g. 50, 100, or 200, EST-related nucleic acids, positional segments of EST-related nucleic acids or fragments of positional segments of EST-related nucleic acids using commercially available oligonucleotide services such as Genset, Paris, France. Preferably, the oligonucleotides are at least 10, 15, 18, 20, 23, 25 28, or 30 nucleotides in length. However, in some embodiments, the oligonucleotides may be more than 40, 50, 60 or 70 nucleotides in length.

Cell samples from the test subject are processed for DNA using techniques well known to those with skill in the art. The nucleic acid is digested with restriction enzymes such as EcoRI and XbaI. Following digestion, samples are applied to wells for electrophoresis. The procedure, as known in the art, may be modified to accommodate polyacrylamide electrophoresis, however in this example, samples containing 5 ug of DNA are loaded into wells and separated on 0.8% agarose gels. The gels are transferred onto nitrocellulose using standard Southern blotting techniques.

10 ng of each of the oligonucleotides are pooled and end-labeled with $p^{32}$. The nitrocellulose is prehybridized with blocking solution and hybridized with the labeled probes. Following hybridization and washing, the nitrocellulose filter is exposed to X-Omat AR X-ray film The resulting hybridization pattern will be unique for each individual.

It is additionally contemplated within this example that the number of probe sequences used can be varied for additional accuracy or clarity.

In addition to their applications in forensics and identification, EST-related nucleic acids, positional segments of EST-related nucleic acids or fragments of positional segments of EST-related nucleic acids may be mapped to their chromosomal locations. Example 41 below describes radiation hybrid (RH) mapping of human chromosomal regions using EST-related nucleic acids, positional segments of EST-related nucleic acids or fragments of positional segments of EST-related nucleic acids. Example 42 below describes a representative procedure for mapping EST-related nucleic acids, positional segments of EST-related nucleic acids or fragments of positional segments of EST-related nucleic acids to their locations on human chromosomes. Example 43 below describes mapping of EST-related nucleic acids, positional segments of EST-related nucleic acids or fragments of positional segments of EST-related nucleic acids on metaphase chromosomes by Fluorescence In Situ Hybridization (FISH).

2. Use of EST-Related Nucleic Acids, Positional Segments of EST-Related Nucleic Acids or Fragments of Positional Segments of EST-Related Nucleic Acids in Chromosome Mapping

EXAMPLE 43

Radiation Hybrid Mapping of EST-Related Nucleic Acids, Positional Segments of EST-Related Nucleic Acids or Fragments of Positional Segments of EST-Related Nucleic Acids to the Human Genome Radiation hybrid (RH) mapping is a somatic cell genetic approach that can be used for high resolution mapping of the human genome. In this approach, cell lines containing one or more human chromosomes are lethally irradiated, breaking each chromosome into fragments whose size depends on the radiation dose. These fragments are rescued by fusion with cultured rodent cells, yielding subclones containing different portions of the human genome. This technique is described by Benham et al. (*Genomics* 4:509–517, 1989) and Cox et al., (*Science* 250:245–250, 1990), the entire disclosures of which are incorporated herein by reference. The random and independent nature of the subclones permits efficient mapping of any human genome marker. Human DNA isolated from a panel of 80–100 cell lines provides a mapping reagent for ordering EST-related nucleic acids, positional segments of EST-related nucleic acids or fragments of positional segments of EST-related nucleic acids. In this approach, the frequency of breakage between markers is used to measure distance, allowing construction of fine resolution maps as has been done using conventional ESTs (Schuler et al., *Science* 274:540–546, 1996), the entire disclosure of which is incorporated herein by reference.

RH mapping has been used to generate a high-resolution whole genome radiation hybrid map of human chromosome 17q22–q25.3 across the genes for growth hormone (GH) and thymidine kinase (FK) (Foster et al., *Genomics* 33:185–192, 1996), the region surrounding the Gorlin syndrome gene (Obermayr et al., *Eur. J. Hum. Genet.* 4:242–245, 1996), 60 loci covering the entire short arm of chromosome 12 (Raeymaekers et al., *Genomics* 29:170–178, 1995), the region of human chromosome 22 containing the neurofibromatosis type 2 locus (Frazer et al., *Genomics* 14:574–584, 1992) and 13 loci on the long arm of chromosome 5 (Warrington et al., Genomics 11:701–708, 1991), the entire disclosures of which are incorporated herein by reference.

EXAMPLE 44

Mapping of EST-Related Nucleic Acids Positional Segments of EST-Related Nucleic Acids or Fragments of Positional Segments of EST-Related Nucleic Acids to Human Chromosomes Using PCR Techniques EST-related nucleic acids, positional segments of EST-related nucleic acids or fragments of positional segments of EST-related nucleic acids may be assigned to human chromosomes using PCR based methodologies. In such approaches, oligonucleotide primer pairs are designed from EST-related nucleic acids, positional segments of EST-related nucleic acids or fragments of positional segments of EST-related nucleic acids to minimize the chance of amplifying through an intron. Preferably, the oligonucleotide primers are 18–23 bp in length and are designed for PCR amplification. The creation of PCR primers from known sequences is well known to those with skill in the art. For a review of PCR technology see Erlich. in PCR Technology; Principles and Applications for DNA Amplification. 1992. W. H. Freeman and Co., New York, the entire disclosure of which is incorporated herein by reference.

The primers are used in polymerase chain reactions (PCR) to amplify templates from total human genomic DNA. PCR conditions are as follows: 60 ng of genomic DNA is used as a template for PCR with 80 ng of each oligonucleotide primer, 0.6 unit of Taq polymerase, and 1 $\mu$Cu of a 32P-labeled deoxycytidine triphosphate. The PCR is performed in a microplate thermocycler (Techne) under the following conditions: 30 cycles of 94° C., 1.4 min; 55° C., 2 min; and 72° C., 2 min.; with a final extension at 72° C. for 10 min. The amplified products are analyzed on a 6% polyacrylamide sequencing gel and visualized by autoradiography. If the length of the resulting PCR product is identical to the distance between the ends of the primer sequences in the 5'EST from which the primers are derived, then the PCR reaction is repeated with DNA templates from two panels of human-rodent somatic cell hybrids, BIOS PCRable DNA (BIOS Corporation) and NIGMS Human-Rodent Somatic Cell Hybrid Mapping Panel Number 1 (NIGMS, Camden, N.J.).

PCR is used to screen a series of somatic cell hybrid cell lines containing defined sets of human chromosomes for the presence of a given 5' EST. DNA is isolated from the somatic hybrids and used as starting templates for PCRreactions using the primer pairs from the EST-related nucleic acids, positional segments of EST-related nucleic acids or fragments of positional segments of EST-related nucleic acids. Only those somatic cell hybrids with chromosomes containing the human gene corresponding to the EST-related nucleic acids, positional segments of EST-related nucleic acids or fragments of positional segments of EST-related nucleic acids will yield an amplified fragment. The 5'ESTs are assigned to a chromosome by analysis of the segregation pattern of PCR products from the somatic hybrid DNA templates. The single human chromosome present in all cell hybrids that give rise to an amplified fragment is the chromosome containing that EST-related nucleic acids, positional segments of EST-related nucleic acids or fragments of positional segments of EST-related nucleic acids. For a review of techniques and analysis of results from somatic cell gene mapping experiments. (See Ledbetter et al., Genomics 6:475–481 (1990), the entire disclosure of which is incorporated herein by reference).

Alternatively, the EST-related nucleic acids, positional segments of EST-related nucleic acids or fragments of positional segments of EST-related nucleic acids may be mapped to individual chromosomes using FISH as described in Example 45 below.

EXAMPLE 45

Mapping of EST-Related Nucleic Acids, Positional Segments of EST-Related Nucleic Acids or Fragments of Positional Segments of EST-Related Nucleic Acids to Chromosomes Using Fluorescence In Situ Hybridization Fluorescence in situ hybridization allows the EST-related nucleic acids, positional segments of EST-related nucleic acids or fragments of positional segments of EST-related nucleic acids to be mapped to a particular location on a given chromosome. The chromosomes to be used for fluorescence in situ hybridization techniques may be obtained from a variety of sources including cell cultures, tissues, or whole blood.

In a preferred embodiment, chromosomal localization of EST-related nucleic acids, positional segments of EST-related nucleic acids or fragments of positional segments of EST-related nucleic acids are obtained by FISH as described by Cherif et al. (*Proc. Natl. Acad. Sci. U.S.A.*, 87:6639–6643, 1990, the entire disclosure of which is incorporated herein by reference). Metaphase chromosomes are prepared from phytohemagglutinin (PHA)-stimulated blood cell donors. PHA-stimulated lymphocytes from healthy males are cultured for 72 h in RPMI-1640 medium. For synchronization, methotrexate (10 $\mu$M) is added for 17 h, followed by addition of 5-bromodeoxyuridine (5-BrdU, 0.1 mM) for 6 h. Collected (1 $\mu$g/ml) is added for the last 15 min before harvesting the cells. Cells are collected, washed in RPMI, incubated with a hypotonic solution of KCl (75 mM) at 37° C. for 15 min and fixed in three changes of methanol:acetic acid (3:1). The cell suspension is dropped onto a glass slide and air dried. The EST-related nucleic acids, positional segments of EST-related nucleic acids or fragments of positional segments of EST-related nucleic acids is labeled with biotin-16 dUTP by nick translation according to the manufacturer's instructions (Bethesda Research Laboratories, Bethesda, Md.), purified using a Sephadex G-50 column (Pharmacia, Upsala, Sweden) and precipitated. Just prior to hybridization, the DNA pellet is dissolved in hybridization buffer (50% formamide, 2×SSC, 10% dextran sulfate, 1 mg/ml sonicated salmon sperm DNA, pH 7) and the probe is denatured at 70° C. for 5–10 min.

Slides kept at −20° C. are treated for 1 h at 37° C. with RNase A (100 $\mu$g/ml), rinsed three times in 2×SSC and dehydrated in an ethanol series. Chromosome preparations are denatured in 70% formamide, 2×SSC for 2 min at 70° C., then dehydrated at 4° C. The slides are treated with proteinase K (10 $\mu$g/100 ml in 20 mM Tris-HCl, 2 mM $CaCl_2$) at 37° C. for 8 min and dehydrated. The hybridization mixture containing the probe is placed on the slide, covered with a coverslip, sealed with rubber cement and incubated overnight in a humid chamber at 37° C. After hybridization and post-hybridization washes, the biotinylated probe is detected by avidin-FITC and amplified with additional layers of biotinylated goat anti-avidin and avidin-FITC. For chromosomal localization, fluorescent R-bands are obtained as previously described (Cherif et al., supra.). The slides are observed under a LEICA fluorescence microscope (DMRXA). Chromosomes are counterstained with propidium iodide and the fluorescent signal of the probe appears as two symmetrical yellow-green spots on both chromatids of the fluorescent R-band chromosome (red). Thus, a particular EST-related nucleic acids, positional segments of EST-related nucleic acids or fragments of positional segments of EST-related nucleic acids may be localized to a particular cytogenetic R-band on a given chromosome.

Once the EST-related nucleic acids, positional segments of EST-related nucleic acids or fragments of positional segments of EST-related nucleic acids have been assigned to particular chromosomes using the techniques described in Examples 42–44 above, they may be utilized to construct a high resolution map of the chromosomes on which they are located or to identify the chromosomes in a sample.

EXAMPLE 46

Use of EST-Related Nucleic Acids, Positional Segments of EST-Related Nucleic Acids or Fragments of Positional Segments of EST-Related Nucleic Acids to Construct or Expand Chromosome Maps Chromosome mapping involves assigning a given unique sequence to a particular chromosome as described above. Once the unique sequence has been mapped to a given chromosome, it is ordered relative to other unique sequences located on the same chromosome. One approach to chromosome mapping utilizes a series of yeast artificial chromosomes (YACs) bearing several thousand long inserts derived from the chromosomes of the organism from which the EST-related nucleic acids, positional segments of EST-related nucleic acids or fragments of positional segments of EST-related nucleic acids are obtained. This approach is described in Ramaiah Nagaraja et al., *Genome Research* 7:210–222, March 1997, the entire disclosure of which is incorporated herein by reference. Briefly, in this approach each chromosome is broken into overlapping pieces which are inserted into the YAC vector. The YAC inserts are screened using PCR or other methods to determine whether they include the EST-related nucleic acids, positional segments of EST-related nucleic acids or fragments of positional segments of EST-related nucleic acids whose position is to be determined. Once an insert has been found which includes the 5'EST, the insert can be analyzed by PCR or other methods to determine whether the insert also contains other sequences known to be on the chromosome or in the region from which the EST-related nucleic acids, positional segments of EST-related nucleic acids or fragments of positional segments of EST-related nucleic acids was derived. This process can be repeated for each insert in the YAC library to determine the location of each of the EST-related nucleic acids, positional segments of EST-related nucleic acids or fragments of positional segments of EST-related nucleic acids relative to one another and to other known chromosomal markers. In this way, a high resolution map of the distribution of numerous unique markers along each of the organisms chromosomes may be obtained.

As described in Example 47 below EST-related nucleic acids, positional segments of EST-related nucleic acids or fragments of positional segments of EST-related nucleic acids may also be used to identify genes associated with a particular phenotype, such as hereditary disease or drug response.

3. Use of EST-Related Nucleic Acids, Positional Segments of EST-Related Nucleic Acids or Fragments of Positional Segments of EST-Related Nucleic Acids Gene Identification

EXAMPLE 47

Identification of Genes Associated with Hereditary Diseases or Drug Response

This example illustrates an approach useful for the association of EST-related nucleic acids, positional segments of EST-related nucleic acids or fragments of positional segments of EST-related nucleic acids with particular phenotypic characteristics. In this example, a particular EST-related nucleic acids, positional segments of EST-related nucleic acids or fragments of positional segments of EST-related nucleic acids is used as a test probe to associate that EST-related nucleic acids, positional segments of EST-related nucleic acids or fragments of positional segments of EST-related nucleic acids with a particular phenotypic characteristic.

EST-related nucleic acids, positional segments of EST-related nucleic acids or fragments of positional segments of EST-related nucleic acids are napped to a particular location on a human chromosome using techniques such as those described in Examples 41 and 42 or other techniques known in the art. A search of Mendelian Inheritance in Man (V. McKusick, *Mendelian Inheritance in Man* (available on line through Johns Hopkins University Welch Medical Library) reveals the region of the human chromosome which contains the EST-related nucleic acids, positional segments of EST-related nucleic acids or fragments of positional segments of EST-related nucleic acids to be a very gene rich region containing several known genes and several diseases or phenotypes for which genes have not been identified. The gene corresponding to this EST-related nucleic acids, positional segments of EST-related nucleic acids or fragments of positional segments of EST-related nucleic acids thus becomes an immediate candidate for each of these genetic diseases.

Cells from patients with these diseases or phenotypes are isolated and expanded in culture. PCR primers from the EST-related nucleic acids, positional segments of EST-related nucleic acids or fragments of positional segments of EST-related nucleic acids are used to screen genomic DNA, mRNA or cDNA obtained from the patients. EST-related nucleic acids, positional segments of EST-related nucleic acids or fragments of positional segments of EST-related nucleic acids that are not amplified in the patients can be positively associated with a particular disease by further analysis. Alternatively, the PCR analysis may yield fragments of different lengths when the samples are derived from an individual having the phenotype associated with the disease than when the sample is derived from a healthy individual, indicating that the gene containing the EST-related nucleic acids, positional segments of EST-related nucleic acids or fragments of positional segments of EST-related nucleic acids may be responsible for the genetic disease.

VII. Use of EST-Related Nucleic Acids, Positional Segments of EST-Related Nucleic Acids or Fragments of Positional Segments of EST-Related Nucleic Acids to Construct Vectors The present EST-related nucleic acids, positional segments of EST-related nucleic acids or fragments of positional segments of EST-related nucleic acids may also be used to construct secretion vectors capable of directing the secretion of the proteins encoded by genes therein. Such secretion vectors may facilitate the purification or enrichment of the proteins encoded by genes inserted therein by reducing the number of background proteins from which the desired protein must be purified or enriched. Exemplary secretion vectors are described in Example 48 below.
1. Construction of Secretion Vectors

EXAMPLE 48

Construction of Secretion Vectors

The secretion vectors of the present invention include a promoter capable of directing gene expression in the host cell, tissue, or organism of interest Such promoters include the Rous Sarcoma Virus promoter, the SV40 promoter, the human cytomegalovirus promoter, and other promoters familiar to those skilled in the art.

A signal sequence from one of the EST-related nucleic acids, positional segments of EST-related nucleic acids or fragments of positional segments of EST-related nucleic acids is operably linked to the promoter such that the mRNA transcribed from the promoter will direct the translation of the signal peptide. Preferably, the signal sequence is from one of the nucleic acids of SEQ ID NOs. 24–811. The host cell, tissue, or organism may be any cell, tissue, or organism which recognizes the signal peptide encoded by the signal sequence in the EST-related nucleic acids, positional segments of EST-related nucleic acids or fragments of positional segments of EST-related nucleic acids. Suitable hosts include mammalian cells, tissues or organisms, avian cells, tissues, or organisms, insect cells, tissues or organisms, or yeast.

In addition, the secretion vector contains cloning sites for inserting genes encoding the proteins which are to be secreted. The cloning sites facilitate the cloning of the insert gene in frame with the signal sequence such that a fusion protein in which the signal peptide is fused to the protein encoded by the inserted gene is expressed from the mRNA transcribed from the promoter. The signal peptide directs the extracellular secretion of the fusion protein.

The secretion vector may be DNA or RNA and may integrate into the chromosome of the host, be stably maintained as an extrachromosomal replicon in the host, be an artificial chromosome, or be transiently present in the host. Preferably, the secretion vector is maintained in multiple copies in each host cell. As used herein, multiple copies means at least 2, 5, 10, 20, 25, 50 or more than 50 copies per cell. In some embodiments, the multiple copies are maintained extrachromosomally. In other embodiments, the multiple copies result from amplification of a chromosomal sequence.

Many nucleic acid backbones suitable for use as secretion vectors are known to those skilled in the art, including retroviral vectors, SV40 vectors, Bovine Papilloma Virus vectors, yeast integrating plasmids, yeast episomal plasmids, yeast artificial chromosomes, human artificial chromosomes, P element vectors, baculovirus vectors, or bacterial plasmids capable of being transiently introduced into the host The secretion vector may also contain a polyA signal such that the polyA signal is located downstream of the gene inserted into the secretion vector.

After the gene encoding the protein for which secretion is desired is inserted into the secretion vector, the secretion vector is introduced into the host cell, tissue, or organism using calcium phosphate precipitation, DEAE-Dextran, electroporation, liposome-mediated transfection, viral particles or as naked DNA. The protein encoded by the inserted gene is then purified or enriched from the supernatant using conventional techniques such as ammonium sulfate precipitation, immunoprecipitation, immunoaffinitychromatography, size exclusion chromatography, ion exchange chromatography, and HPLC. Alternatively, the secreted protein may be in a sufficiently enriched or pure state in the supernatant or growth media of the host to permit it to be used for its intended purpose without further enrichment.

The signal sequences may also be inserted into vectors designed for gene therapy. In such vectors, the signal sequence is operably linked to a promoter such that mRNA transcribed from the promoter encodes the signal peptide. A cloning site is located downstream of the signal sequence such that a gene encoding a protein whose secretion is desired may readily be inserted into the vector and fused to the signal sequence. The vector is introduced into an appropriate host cell. The protein expressed from the promoter is secreted extracellularly, thereby producing a therapeutic effect.

EXAMPLE 49

Fusion Vectors

The EST-related nucleic acids, positional segments of EST-related nucleic acids or fragments of positional segments of EST-related nucleic acids may be used to construct fusion vectors for the expression of chimeric polypeptides. The chimeric polypeptides comprise a first polypeptide portion and a second polypeptide portion. In the fusion vectors of the present invention, nucleic acids encoding the first polypeptide portion and the second polypeptide portion are joined in frame with one another so as to generate a nucleic acid encoding the chimeric polypeptide. The nucleic acid encoding the chimeric polypeptide is operably linked to a promoter which directs the expression of an mRNA encoding the chimeric polypeptide. The promoter may be in any of the expression vectors described herein including those described in Examples 21 and 48.

Preferably, the fusion vector is maintained in multiple copies in each host cell. In some embodiments, the multiple copies are maintained extrachromosomally. In other embodiments, the multiple copies result from amplification of a chromosomal sequence.

The first polypeptide portion may comprise any of the polypeptides encoded by the EST-related nucleic acids, positional segments of EST-related nucleic acids or fragments of positional segments of EST-related nucleic acids. In some embodiments, the fist polypeptide portion may be one of the EST-related polypeptides, fragments of EST-related polypeptides, positional segments of EST-related polypeptides, or fragments of positional segments of EST-related polypeptides.

The second polypeptide portion may comprise any polypeptide of interest. In some embodiments, the second polypeptide portion may comprise a polypeptide having a detectable enzymatic activity such as green fluorescent protein or β galactosidase. Chimeric polypeptides in which the second polypeptide portion comprises a detectable polypeptide may be used to determine the intracellular localization of the first polypeptide portion. In such procedures, the fusion vector encoding the chimeric polypeptide is introduced into a host cell under conditions which facilitate the expression of the chimeric polypeptide. Where appropriate, the cells are treated with a detection reagent which is visible under the microscope following a catalytic reaction with the detectable polypeptide and the cellular location of the detection reagent is determined. For example, if the polypeptide having a detectable enzymatic activity is β galactosidase, the cells may be treated with XgaI. Alternatively, where the detectable polypeptide is directly detectable without the addition of a detection reagent, the intracellular location of the chimeric polypeptide is determined by performing microscopy under conditions in which the dectable polypeptide is visible. For example, if the detectable polypeptide is green fluorescent protein or a modified version thereof, microscopy is performed by exposing the host cells to light having an appropriate wavelength to cause the green fluorescent protein or modified version thereof to fluoresce.

Alternatively, the second polypeptide portion may comprise a polypeptide whose isolation, purification, or enrichment is desired. In such embodiments, the isolation, purification, or enrichment of the second polypeptide portion may be achieved by performing the immunoaffinity chromatography procedures described below using an immunoaffinity column having an antibody directed against the first polypeptide portion coupled thereto.

The proteins encoded by the EST-related nucleic acids, positional segments of EST-related nucleic acids or fragments of positional segments of EST-related nucleic acids or the EST-related polypeptides, fragments of EST-related polypeptides, positional segments of EST-related polypeptides, or fragments of positional segments of EST-related polypeptides may also be used to generate antibodies as explained herein in order to identify the tissue type or cell species from which a sample is derived as described in Example 50.

EXAMPLE 50

Identification of Tissue Types or Cell Species by Means of Labeled Tissue Specific Antibodies Identification of specific tissues is accomplished by the visualization of tissue specific antigens by means of antibody preparations as described herein which are conjugated, directly or indirectly to a detectable marker. Selected labeled antibody species bind to their specific antigen binding partner in tissue sections, cell suspensions, or in extracts of soluble proteins from a tissue sample to provide a pattern for qualitative or semi-qualitative interpretation.

Antisera for these procedures must have a potency exceeding that of the native preparation, and for that reason, antibodies are concentrated to a mg/ml level by isolation of the gamma globulin fraction, for example, by ion-exchange chromatography or by ammonium sulfate fractionation. Also, to provide the most specific antisera, unwanted antibodies, for example to common proteins, must be removed from the gamma globulin fraction, for example by means of insoluble immunoabsorbents, before the antibodies are labeled with the marker. Either monoclonal or heterologous antisera is suitable for either procedure.

1. Immunohistochemical Techniques

Purified, high-titer antibodies, prepared as described above, are conjugated to a detectable marker, as described, for example, by Fudenberg, H., Chap. 26 in. Basic 503 *Clinical Immunology*, $3^{rd}$ Ed. Lange, Los Altos, Calif. (1980) or Rose, et al., Chap. 12 in: *Methods in Immunodiagnosis*, 2d Ed. John Wiley and Sons, New York (1980), the entire disclosures of which are incorporated herein by reference.

A fluorescent marker, either fluorescein or rhodamine, is preferred, but antibodies can also be labeled with an enzyme that supports a color producing reaction with a substrate, such as horseradish peroxidase. Markers can be added to tissue-bound antibody in a second step, as described below. Alternatively, the specific antitissue antibodies can be labeled with ferritin or other electron dense particles, and localization of the ferritin coupled antigen-antibody complexes achieved by means of an electron microscope. In yet another approach, the antibodies are radiolabeled, with, for example $^{125}$I, and detected by overlaying the antibody treated preparation with photographic emulsion.

Preparations to carry out the procedures can comprise monoclonal or polyclonal antibodies to a single protein or peptide identified as specific to a tissue type, for example, brain tissue, or antibody preparations to several antigenically distinct tissue specific antigens can be used in panels, independently or in mixtures, as required.

Tissue sections and cell suspensions are prepared for immunohistochemical examination according to common histological techniques. Multiple cryostat sections (about 4 μm, unfixed) of the unknown tissue and known control, are mounted and each slide covered with different dilutions of the antibody preparation. Sections of known and unknown tissues should also be treated with preparations to provide a positive control, a negative control, for example, pre-immune sera, and a control for non-specific staining, for example, buffer.

Treated sections are incubated in a humid chamber for 30 min at room temperature, rinsed, then washed in buffer for 30–45 min. Excess fluid is blotted away, and the marker developed.

If the tissue specific antibody was not labeled in the first incubation, it can be labeled at this time in a second antibody-antibody reaction, for example, by adding fluorescein- or enzyme-conjugated antibody against the immunoglobulin class of the antiserum-producing species, for example, fluorescein labeled antibody to mouse IgG. Such labeled sera are commercially available.

The antigen found in the tissues by the above procedure can be quantified by measuring the intensity of color or fluorescence on the tissue section, and calibrating that signal using appropriate standards.

2. Identification of Tissue Specific Soluble Proteins

The visualization of tissue specific proteins and identification of unknown tissues from that procedure is carried out using the labeled antibody reagents and detection strategy as described for immunohistochemistry; however the sample is prepared according to an electrophoretic technique to distribute the proteins extracted from the tissue in an orderly array on the basis of molecular weight for detection.

A tissue sample is homogenized using a Virtis apparatus; cell suspensions are disrupted by Dounce homogenization or osmotic lysis, using detergents in either case as required to disrupt cell membranes, as is the practice in the art. Insoluble cell components such as nuclei, microsomes, and membrane fragments are removed by ultracentrifigation, and the soluble protein-containing fraction concentrated if necessary and reserved for analysis.

A sample of the soluble protein solution is resolved into individual protein species by conventional SDS polyacrylamide electrophoresis as described, for example, by Davis, L. et al., Section 19-2 in: *Basic Methods in Molecular Biology* (P. Leder, ed), Elsevier, N.Y. (1986), using a range of amounts of polyacrylamide in a set of gels to resolve the entire molecular weight range of proteins to be detected in the sample. A size marker is run in parallel for purposes of estimating molecular weights of the constituent proteins. Sample size for analysis is a convenient volume of from 5 to 55 μl, and containing from about 1 to 100 μg protein. An aliquot of each of the resolved proteins is transferred by blotting to a nitrocellulose filter paper, a process that maintains the pattern of resolution. Multiple copies are prepared. The procedure, known as Western Blot Analysis, is well described in Davis, L. et al., supra Section 19-3, the entire disclosure of which is incorporated herein by reference. One set of nitrocellulose blots is stained with Coomassie Blue dye to visualize the entire set of proteins for comparison with the antibody bound proteins. The remaining nitrocellulose filters are then incubated with a solution of one or more specific antisera to tissue specific proteins prepared as described in Examples 20 and 33. In this procedure, as in procedure A above, appropriate positive and negative sample and reagent controls are run.

In either procedure described above a detectable label can be attached to the primary tissue antigen-primary antibody complex according to various strategies and permutations thereof. In a straightforward approach, the primary specific antibody can be labeled; alternatively, the unlabeled complex can be bound by a labeled secondary anti-IgG antibody. In other approaches, either the primary or secondary antibody is conjugated to a biotin molecule, which can, in a subsequent step, bind an avidin conjugated marker. According to yet another strategy, enzyme labeled or radioactive protein A, which has the property of binding to any IgG, is bound in a final step to either the primary or secondary antibody.

EXAMPLE 51

Immunohistochemical Localization of Polypeptides

The antibodies prepared as described herein above may be utilized to determine the cellular location of a polypeptide. The polypeptide may be any of the polypeptides encoded by EST-related nucleic acids, positional segments of EST-related nucleic acids or fragments of positional segments of EST-related nucleic acids or the polypeptide may be one of the EST-related polypeptides, fragments of EST-related polypeptides, positional segments of EST-related polypeptides, or fragments of positional segments of EST-related polypeptides. In some embodiments, the polypeptide may be a chimeric polypeptide such as those encoded by the fusion vectors of Example 49.

Cells expressing the polypeptide to be localized are applied to a microscope slide and fixed using any of the procedures typically employed in immunohistochemical localization techniques, including the methods described in *Current Protocols in Molecular Biology*, John Wiley and Sons, Inc. 1997. Following a washing step, the cells are contacted with the antibody. In some embodiments, the antibody is conjugated to a detectable marker as described above to facilitate detection. Alternatively, in some embodiments, after the cells have been contacted with an antibody to the polypeptide to be localized, a secondary antibody which has been conjugated to a detectable marker is placed in contact with the antibody against the polypeptide to be localized.

Thereafter, microscopy is performed under conditions suitable for visualizing the cellular location of the polypeptide.

The visualization of tissue specific antigen binding at levels above those seen in control tissues to one or more tissue specific antibodies, directed against the polypeptides encoded by EST-related nucleic acids, positional segments of EST-related nucleic acids or fragments of positional segments of EST-related nucleic acids or antibodies against the EST-related polypeptides, fragments of EST-related polypeptides, positional segments of EST-related polypeptides, or fragments of positional segments of EST-related polypeptides, can identify tissues of unknown origin, for example, forensic samples, or differentiated tumor tissue that has metastasized to foreign bodily sites.

The antibodies described herein may also be used in the immunoaffinity chromatography techniques described below to isolate, purify or enrich the polypeptides encoded by the EST-related nucleic acids, positional segments of EST-related nucleic acids or fragments of positional segments of EST-related nucleic acids or to isolate, purify or enrich EST-related polypeptides, fragments of EST-related polypeptides, positional segments of EST-related polypeptides, or fragments of positional segments of EST-related polypeptides. The immunoaffinity chromatography techniques described below may also be used to isolate, purify or enrich polypeptides which have been linked to the polypeptides encoded by the EST-related nucleic acids, positional segments of EST-related nucleic acids or fragments of positional segments of EST-related nucleic acids or to isolate, purify or enrich polypeptides which have been linked to EST-related polypeptides, fragments of EST-related polypeptides, positional segments of EST-related polypeptides, or fragments of positional segments of EST-related polypeptides.

EXAMPLE 52

Immunoaffinity Chromatography

Antibodies prepared as described above are coupled to a support. Preferably, the antibodies are monoclonal antibodies, but polyclonal antibodies may also be used. The support may be any of those typically employed in immunoaffinity chromatography, including Sepharose CL-4B (Pharmacia, Piscataway, N.J.), Sepharose CL-2B (Pharmacia, Piscataway, N.J.), Affi-gel 10 (Biorad, Richmond, Calif.), or glass beads.

The antibodies may be coupled to the support using any of the coupling reagents typically used in immunoaffinity chromatography, including cyanogen bromide. After coupling the antibody to the support, the support is contacted with a sample which contains a target polypeptide whose isolation, purification or enrichment is desired. The target polypeptide may be a polypeptide encoded by the EST-related nucleic acids, positional segments of EST-related nucleic acids or fragments of positional segments of EST-related nucleic acids or the target polypeptide may be one of the EST-related polypeptides, fragments of EST-related polypeptides, positional segments of EST-related polypeptides, or fragments of positional segments of EST-related polypeptides. The target polypeptides may also be polypeptides which have been linked to the polypeptides encoded by the EST-related nucleic acids, positional segments of EST-related nucleic acids or fragments of positional segments of EST-related nucleic acids or the target polypeptides may be polypeptides which have been linked to EST-related polypeptides, fragments of EST-related polypeptides, positional segments of EST-related polypeptides, or fragments of positional segments of EST-related polypeptides using the fusion vectors described above.

Preferably, the sample is placed in contact with the support for a sufficient amount of time and under appropriate conditions to allow at least 50% of the target polypeptide to specifically bind to the antibody coupled to the support.

Thereafter, the support is washed with an appropriate wash solution to remove polypeptides which have non-specifically adhered to the support. The wash solution may be any of those typically employed in immunoaffinity chromatography, including PBS, Tris-lithium chloride buffer (0.1M lysine base and 0.5M lithium chloride, pH 8.0), Tris-hydrochloride buffer (0.05M Tris-hydrochloride, pH 8.0), or Tris/Triton/NaCl buffer (50 mM Tris.cl, pH 8.0 or 9.0, 0.1% Triton X-100, and 0.5MNaCl).

After washing, the specifically bound target polypeptide is eluted from the support using the high pH or low pH elution solutions typically employed in immunoaffinity chromatography. In particular, the elution solutions may contain an eluant such as triethanolamine, diethylamine, calcium chloride, sodium thiocyanate, potasssium bromide, acetic acid, or glycine. In some embodiments, the elution solution may also contain a detergent such as Triton X-100 or octyl-β-D-glucoside.

The EST-related nucleic acids, positional segments of EST-related nucleic acids or fragments of positional segments of EST-related nucleic acids may also be used to clone sequences located upstream of the 5'ESTs which are capable of regulating gene expression, including promoter sequences, enhancer sequences, and other upstream sequences which influence transcription or translation levels. Once identified and cloned, these upstream regulatory sequences may be used in expression vectors designed to direct the expression of an inserted gene in a desired spatial, temporal, developmental, or quantitative fashion. Example 51 describes a method for cloning sequences upstream of the EST-related nucleic acids, positional segments of EST-related nucleic acids or fragments of positional segments of EST-related nucleic acids.

2. Identification of Upstream Sequences with Promoting or Regulatory Activities

EXAMPLE 53

Use of EST-Related Nucleic Acids, Positional Segments of EST-related Nucleic Acids or Fragments of Positional Segments of EST-related Nucleic Acids to Clone Upstream Sequences from Genomic DNA Sequences derived from EST-related nucleic acids, positional segments of EST-related nucleic acids or fragments of positional segments of EST-related nucleic acids may be used to isolate the promoters of the corresponding genes using chromosome walking techniques. In one chromosome walking technique, which utilizes the GenomeWalker™ kit available from Clontech, five complete genomic DNA samples are each digested with a different restriction enzyme which has a 6 base recognition site and leaves a blunt end. Following digestion, oligonucleotide adapters are ligated to each end of the resulting genomic DNA fragments.

For each of the five genomic DNA libraries, a first PCR reaction is performed according to the manufacturer's instructions using an outer adapter primer provided in the kit and an outer gene specific primer. The gene specific primer should be selected to be specific for 5' EST of interest and should have a melting temperature, length, and location in the EST-related nucleic acids, positional segments of EST-related nucleic acids or fragments of positional segments of EST-related nucleic acids which is consistent with its use in PCR reactions. Each first PCR reaction contains 5 ng of genomic DNA, 5 µl of 10× Tth reaction buffer, 0.2 mM of each dNTP, 0.2 µM each of outer adapter primer and outer gene specific primer, 1.1 mM of Mg(OAc)$_2$, and 1 µl of the Tth polymerase 50× mix in a total volume of 50 µl. The reaction cycle for the first PCR reaction is as follows: 1 min at 94° C./2 sec at 94° C., 3 min at 72° C. (7 cycles)/2 sec at 94° C., 3 min at 67° C. (32 cycles)/5 min at 67° C.

The product of the first PCR reaction is diluted and used as a template for a second PCR reaction according to the manufacturer's instructions using a pair of nested primers which are located internally on the amplicon resulting from the first PCR reaction. For example, 5 µl of the reaction product of the first PCR reaction mixture may be diluted 180 times. Reactions are made in a 50 µl volume having a composition identical to that of the first PCR reaction except the nested primers are used. The first nested primer is specific for the adapter, and is provided with the GenomeWalker™ kit. The second nested primer is specific for the particular EST-related nucleic acids, positional segments of EST-related nucleic acids or fragments of positional segments of EST-related nucleic acids for which the promoter is to be cloned and should have a melting temperature, length, and location in the EST-related nucleic acids, positional segments of EST-related nucleic acids or fragments of positional segments of EST-related nucleic acids which is consistent with its use in PCR reactions. The reaction parameters of the second PCR reaction are as follows: 1 min at 94° C./2 sec at 94° C., 3 min at 72° C. (6 cycles)/2 sec at 94° C., 3 min at 67° C. (25 cycles)/5 min at 67° C. The product of the second PCR reaction is purified, cloned, and sequenced using standard techniques.

Alternatively, two or more human genomic DNA libraries can be constructed by using two or more restriction enzymes. The digested genomic DNA is cloned into vectors which can be converted into single stranded, circular, or linear DNA. A biotinylated oligonucleotide comprising at least 10, 12, 15, 18, 20, 23, 25, 27, 30, 35, 40, or 50 nucleotides from the EST-related nucleic acids, positional segments of EST-related nucleic acids or fragments of positional segments of EST-related nucleic acids sequence is hybridized to the single stranded DNA. Hybrids between the biotinylated oligonucleotide and the single stranded DNA containing the EST-related nucleic acids, positional segments of EST-related nucleic acids or fragments of positional segments of EST-related nucleic acids are isolated as described above. Thereafter, the single stranded DNA containing the EST-related nucleic acids, positional segments of EST-related nucleic acids or fragments of positional segments of EST-related nucleic acids is released from the beads and converted into double stranded DNA using a primer specific for the EST-related nucleic acids, positional segments of EST-related nucleic acids or fragments of positional segments of EST-related nucleic acids or a primer corresponding to a sequence included in the cloning vector. The resulting double stranded DNA is transformed into bacteria. cDNAs containing the EST-related nucleic acids, positional segments of EST-related nucleic acids or fragments of positional segments of EST-related nucleic acids are identified by colony PCR or colony hybridization.

Once the upstream genomic sequences have been cloned and sequenced as described above, prospective promoters and transcription start sites within the upstream sequences may be identified by comparing the sequences upstream of the EST-related nucleic acids, positional segments of EST-related nucleic acids or fragments of positional segments of EST-related nucleic acids with databases containing known transcription start sites, transcription factor binding sites, or promoter sequences.

In addition, promoters in the upstream sequences may be identified using promoter reporter vectors as described in Example 54.

EXAMPLE 54

Identification of Promoters in Cloned Upstream Sequences

The genomic sequences upstream of the EST-related nucleic acids, positional segments-of EST-related nucleic acids or fragments of positional segments of EST-related nucleic acids are cloned into a suitable promoter reporter vector, such as the pSEAP-Basic, pSEAP-Enhancer, pβ-gal-Basic, pβ-gal-Enhancer, or pEGFP-1 Promoter Reporter vectors available from Clontech. Briefly, each of these promoter reporter vectors include multiple cloning sites positioned upstream of a reporter gene encoding a readily assayable protein such as secreted alkaline phosphatase, β-galactosidase, or green fluorescent protein. The sequences upstream of the EST-related nucleic acids, positional segments of EST-related nucleic acids or fragments of positional segments of EST-related nucleic acids are inserted into the cloning sites upstream of the reporter gene in, both orientations and introduced into an appropriate host cell. The level of reporter protein is assayed and compared to the level obtained from a vector which lacks an insert in the cloning site. The presence of an elevated expression level in the vector containing the insert with respect to the control vector indicates the presence of a promoter in the insert. If necessary, the upstream sequences can be cloned into vectors which contain an enhancer for augmenting transcription levels from weak promoter sequences. A significant level of expression above that observed with the vector lacking an insert indicates that a promoter sequence is present in the inserted upstream sequence.

Appropriate host cells for the promoter reporter vectors may be chosen based on the results of the above described determination of expression patterns of the EST-related nucleic acids, positional segments of EST-related nucleic acids or fragments of positional segments of EST-related nucleic acids. For example, if the expression pattern analysis indicates that the mRNA corresponding to a particular EST-related nucleic acids, positional segments of EST-related nucleic acids or fragments of positional segments of EST-related nucleic acids is expressed in fibroblasts, the promoter reporter vector may be introduced into a human fibroblast cell line.

Promoter sequences within the upstream genomic DNA may be further defined by constructing nested deletions in the upstream DNA using conventional techniques such as Exonuclease III digestion. The resulting deletion fragments can be inserted into the promoter reporter vector to determine whether the deletion has reduced or obliterated promoter activity. In this way, the boundaries of the promoters may be defined. If desired, potential individual regulatory sites within the promoter may be identified using site directed mutagenesis or linker scanning to obliterate potential transcription factor binding sites within the promoter individually or in combination. The effects of these mutations on transcription levels may be determined by inserting the mutations into the cloning sites in the promoter reporter vectors.

EXAMPLE 55

Cloning and Identification of Promoters

Using the method described in Example 54 above with 5' ESTs, sequences upstream of several genes were obtained.

Using the primer pairs GGG AAG ATG GAG ATA GTA TTG CCT G (SEQ ID NO:15) and CTG CCA TGT ACA TGA TAG AGA GAT TC (SEQ ID NO:16), the promoter having the internal designation P13H2 (SEQ ID NO:17) was obtained.

Using the primer pairs GTA CCA GGG ACT GTG ACC ATT GC (SEQ ID NO:18) and CTG TGA CCA TTG CTC CCA AGA GAG (SEQ ID NO:19), the promoter having the internal designation P15B4 (SEQ ID NO:20) was obtained.

Using the primer pairs CTG GGA TGG AAG GCA CGG TA (SEQ ID NO:21) and GAG ACC ACA CAG CIA GAC AA (SEQ ID NO:22), the promoter having the internal designation P29B6 (SEQ ID NO:23) was obtained.

Figure 4:
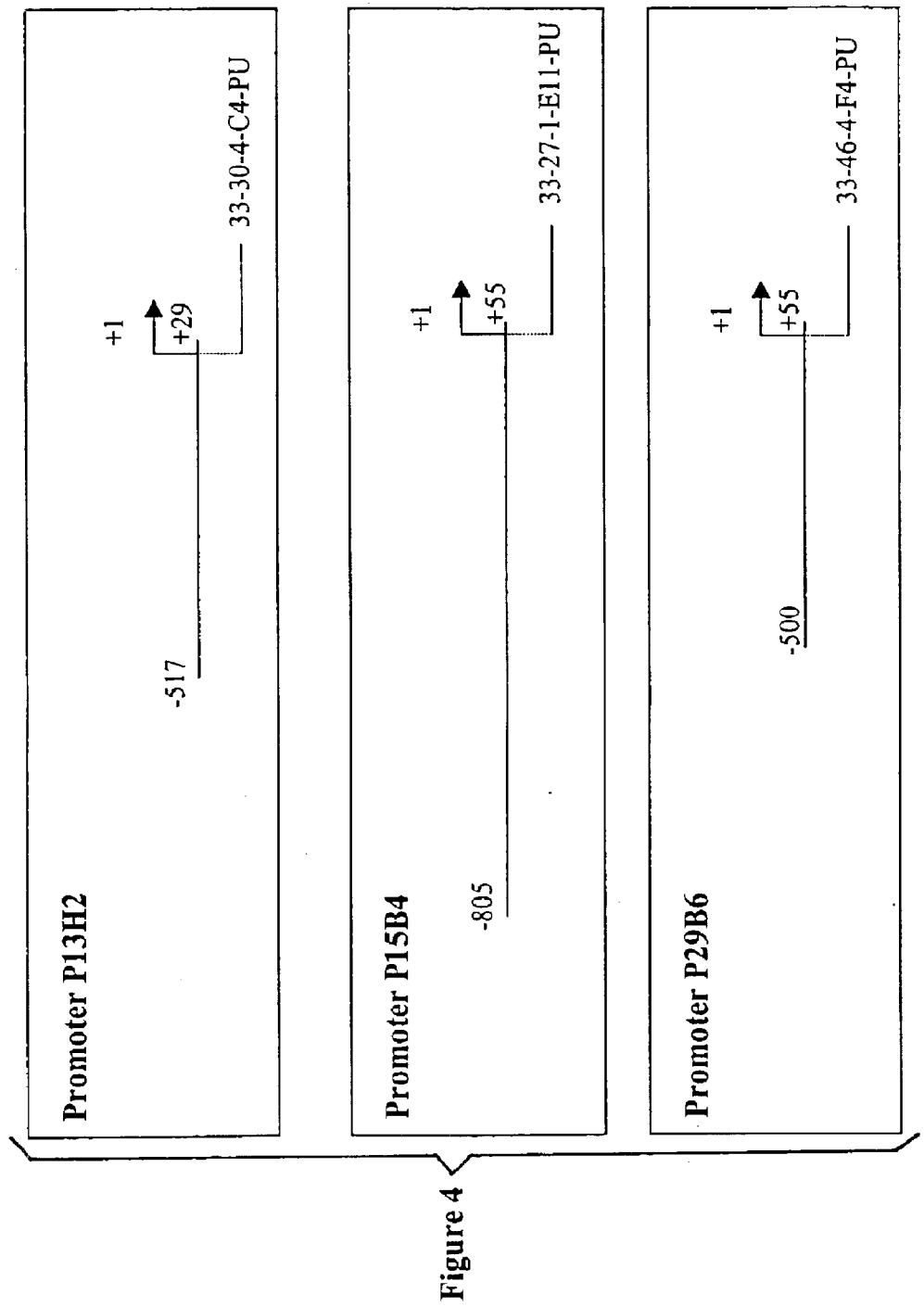
FIG. 4 provides a schematic description of the promoters isolated and the way they are assembled with the corresponding 5' tags.

FIG. 4 provides a schematic description of the promoters isolated and the way they are assembled with the corresponding 5' tags. The upstream sequences were screened for the presence of motifs resembling transcription factor binding sites or known transcription start sites using the computer program MatInspector release 20, Aug. 1996.

The transcription factor binding sites present in each of these promoters are listed as protein binding sites in the sequence listing for SEQ ID NOs: 17, 20, and 23.

Bacterial clones containing plasmids containing the promoter sequences described above described above are presently stored in the inventor's laboratories under the internal identification numbers provided above. The inserts may be recovered from the deposited materials by growing an aliquot of the appropriate bacterial clone in the appropriate medium. The plasmid DNA can then be isolated using plasmid isolation procedures familiar to those skilled in the art such as alkaline lysis minipreps or large scale alkaline lysis plasmid isolation procedures. If desired the plasmid DNA may be further enriched by centrifugation on a cesium chloride gradient, size exclusion chromatography, or anion exchange chromatography. The plasmid DNA obtained using these procedures may then be manipulated using standard cloning techniques familiar to those skilled in the art. Alternatively, a PCR can be done with primers designed at both ends of the inserted EST-related nucleic acids, positional segments of EST-related nucleic acids or fragments of positional segments of EST-related nucleic acids. The PCR product which corresponds to the EST-related nucleic acids, positional segments of EST-related nucleic acids or fragments of positional segments of EST-related nucleic acids can then be manipulated using standard cloning techniques familiar to those skilled in the art.

The promoters and other regulatory sequences located upstream of the EST-related nucleic acids, positional segments of EST-related nucleic acids or fragments of positional segments of EST-related nucleic acids may be used to design expression vectors capable of directing the expression of an inserted gene in a desired spatial, temporal, developmental, or quantitative manner. A promoter capable of directing the desired spatial, temporal, developmental, and quantitative patterns may be selected using the results of the expression analysis described above. For example, if a promoter which confers a high level of expression in muscle is desired, the promoter sequence upstream of EST-related nucleic acids, positional segments of EST-related nucleic acids or fragments of positional segments of EST-related nucleic acids derived from an mRNA which are expressed at a high level in muscle, as determined by the methods above, may be used in the expression vector.

Preferably, the desired promoter is placed near multiple restriction sites to facilitate the cloning of the desired insert downstream of the promoter, such that the promoter is able to drive expression of the inserted gene. The promoter may be inserted in conventional nucleic acid backbones designed for extrachromosomal replication, integration into the host chromosomes or transient expression. Suitable backbones for the present expression vectors include retroviral backbones, backbones from eukaryotic episomes such as SV40 or Bovine Papilloma Virus, backbones from bacterial episomes, or artificial chromosomes.

Preferably, the expression vectors also include a polyA signal downstream of the multiple restriction sites for directing the polyadenylation of mRNA transcribed from the gene inserted into the expression vector.

Following the identification of promoter sequences, proteins which interact with the promoter may be identified as described in Example 56 below.

EXAMPLE 56

Identification of Proteins which Interact with Promoter Sequences, Upstream Regulatory Sequences, or mRNA Sequences within the promoter region which are likely to bind transcription factors may be identified by homology to known transcription factor binding sites or through conventional mutagenesis or deletion analyses of reporter plasmids containing the promoter sequence. For example, deletions may be made in a reporter plasmid containing the promoter sequence of interest operably linked to an assayable reporter gene. The reporter plasmids carrying various deletions within the promoter region are transfected into an appropriate host cell and the effects of the deletions on expression levels is assessed. Transcription factor binding sites within the regions in which deletions reduce expression levels may be further localized using site directed mutagenesis, linker scanning analysis, or other techniques familiar to those skilled in the art.

Nucleic acids encoding proteins which interact with sequences in the promoter may be identified using one-hybrid systems such as those described in the manual accompanying the Matchmaker One-Hybrid System kit available from Clontech (Catalog No. K1603-1). Briefly, the Matchmaker One-hybrid system is used as follows. The target sequence for which it is desired to identify binding proteins is cloned upstream of a selectable reporter gene and integrated into the yeast genome. Preferably, multiple copies of the target sequences are inserted into the reporter plasmid in tandem. A library comprised of fusions between cDNAs to be evaluated for the ability to bind to the promoter and the activation domain of a yeast transcription factor, such as GAL4, is transformed into the yeast strain containing the integrated reporter sequence. The yeast are plated on selective media to select cells expressing the selectable marker linked to the promoter sequence. The colonies which grow on the selective media contain genes encoding proteins which bind the target sequence. The inserts in the genes encoding the fusion proteins are further characterized by sequencing. In addition, the inserts may be inserted into expression vectors or in vitro transcription vectors. Binding of the polypeptides encoded by the inserts to the promoter DNA may be confirmed by techniques familiar to those skilled in the art, such as gel shift analysis or DNAse protection analysis.

VIII. Use of EST-Related Nucleic Acids, Positional Segments of EST-Related Nucleic Acids or Fragments of Positional Segments of EST-Related Nucleic Acids in Gene Therapy The present invention also comprises the use of EST-related nucleic acids, positional segments of EST-related nucleic acids or fragments of positional segments of EST-related nucleic acids in gene therapy strategies, including antisense and triple helix strategies as described in Examples 57 and 58 below. In antisense approaches, nucleic acid sequences complementary to an mRNA are hybridized to the mRNA intracellularly, thereby blocking the expression of the protein encoded by the mRNA. The antisense sequences may prevent gene expression through a variety of mechanisms. For example, the antisense sequences may inhibit the ability of ribosomes to translate the mRNA. Alternatively, the antisense sequences may block transport of the mRNA from the nucleus to the cytoplasm, thereby limiting the amount of mRNA available for translation. Another mechanism through which antisense sequences may inhibit gene expression is by interfering with mRNA splicing. In yet another strategy, the antisense nucleic acid may be incorporated in a ribozyme capable of specifically cleaving the target mRNA.

EXAMPLE 57

Preparation and Use of Antisense Oligonucleotides

The antisense nucleic acid molecules to be used in gene therapy may be either DNA or RNA sequences. They may comprise a sequence complementary to the sequence of the EST-related nucleic acids, positional segments of EST-related nucleic acids or fragments of positional segments of EST-related nucleic acids. The antisense nucleic acids should have a length and melting temperature sufficient to permit formation of an intracellular duplex with sufficient stability to inhibit the expression of the mRNA in the duplex. Strategies for designing antisense nucleic acids suitable for use in gene therapy are disclosed in Green et al., *Ann. Rev. Biochem.* 55:569–597 (1986) and Izant and Weintraub, *Cell* 36:1007–1015 (1984), the entire disclosures of which are incorporated herein by reference.

In some strategies, antisense molecules are obtained from a nucleotide sequence encoding a protein by reversing the orientation of the coding region with respect to a promoter so as to transcribe the opposite strand from that which is normally transcribed in the cell. The antisense molecules may be transcribed using in vitro transcription systems such as those which employ T7 or SP6 polymerase to generate the transcript. Another approach involves transcription of the antisense nucleic acids in vivo by operably linking DNA containing the antisense sequence to a promoter in an expression vector.

Alternatively, oligonucleotides which are complementary to the strand normally transcribed in the cell may be synthesized in vitro. Thus, the antisense nucleic acids are complementary to the corresponding mRNA and are capable of hybridizing to the mRNA to create a duplex. In some embodiments, the antisense sequences may contain modified sugar phosphate backbones to increase stability and make them less sensitive to RNase activity. Examples of modifications suitable for use in antisense strategies are described by Rossi et al., *Pharmacol. Ther.* 50(2):245–254, (1991), the entire disclosure of which is incorporated herein by reference.

Various types of antisense oligonucleotides complementary to the sequence of the EST-related nucleic acids, positional segments of EST-related nucleic acids or fragments of positional segments of EST-related nucleic acids may be used. In one preferred embodiment, stable and semi-stable antiseese oligonucleotides described in International Application No. PCT WO94/23026, the entire disclosure of which is incorporated herein by reference, are used. In these molecules, the 3' end or both the 3' and 5' ends are engaged in intramolecular hydrogen bonding between complementary base pairs. These molecules are better able to withstand exonuclease attacks and exhibit increased stability compared to conventional antisense oligonucleotides.

In another preferred embodiment, the antisense oligodeoxynucleotides against herpes simplex virus types 1 and 2 described in International Application No. WO 95/04141, the entire disclosure of which is incorporated herein by reference, are used.

In yet another preferred embodiment, the covalently cross-linked antisense oligonucleotides described in International Application No. WO 96/31523, the entire disclosure of which is incorporated herein by reference, are used. These double- or single-stranded oligonucleotides comprise one or more, respectively, inter- or intra-oligonucleotide covalent cross-linkages, wherein the linkage consists of an amide bond between a primary amine group of one strand and a carboxyl group of the other strand or of the same strand, respectively, the primary amine group being directly substituted in the 2' position of the strand nucleotide monosaccharide ring, and the carboxyl group being carried by an aliphatic spacer group substituted on a nucleotide or nucleotide analog of the other strand or the same strand, respectively.

The antisense oligodeoxynucleotides and oligonucleotides disclosed in International Application No. WO 92/18522, the entire disclosure of which is incorporated herein by reference, may also be used. These molecules are stable to degradation and contain at least one transcription control recognition sequence which binds to control proteins and are effective as decoys therefor. These molecules may contain "hairpin" structures, "dumbbell" structures, "modified dumbbell" structures, "cross-linked" decoy structures and "loop" structures.

In another preferred embodiment, the cyclic double-stranded oligonucleotides described in European Patent Application No. 0 572 287 A2, the entire disclosure of which is incorporated herein by reference. These ligated oligonucleotide "dumbbells" contain the binding site for a transcription factor and inhibit expression of the gene under control of the transcription factor by sequestering the factor.

Use of the closed antisense oligonucleotides disclosed in International Application No. WO 92/19732 is also contemplated. Because these molecules have no free ends, they are more resistant to degradation by exonucleases than are conventional oligonucleotides. These oligonucleotides may be multifunctional, interacting with several regions which are not adjacent to the target mRNA.

The appropriate level of antisense nucleic acids required to inhibit gene expression may be determined using in viro expression analysis. The antisense molecule may be introduced into the cells by diffusion, injection, infection or transfection using procedures known in the art. For example, the antisense nucleic acids can be introduced into the body as a bare or naked oligonucleotide, oligonucleotide encapsulated in lipid, oligonucleotide sequence encapsidated by viral protein, or as an oligonucleotide operably linked to a promoter contained in an expression vector. The expression vector may be any of a variety of expression vectors known in the art, including retroviralor viral vectors, vectors capable of extrachromosomal replication, or integrating vectors. The vectors may be DNA or RNA.

The antisense molecules are introduced onto cell samples at a number of different concentrations preferably between $1\times10^{-10}$M to $1\times10^{-4}$M. Once the minimum concentration that can adequately control gene expression is identified, the optimized dose is translated into a dosage suitable for use in vivo. For example, an inhibiting concentration in culture of $1\times10^{-7}$ translates into a dose of approximately 0.6 mg/kg bodyweight. Levels of oligonucleotide approaching 100 mg/kg bodyweight or higher may be possible after testing the toxicity of the oligonucleotide in laboratory animals. It is additionally contemplated that cells from the vertebrate are removed, treated with the antisense oligonucleotide, and reintroduced into the vertebrate.

It is further contemplated that the antisense oligonucleotide sequence is incorporated into a ribozyme sequence to enable the antisense to specifically bind and cleave its target mRNA. For technical applications of ribozyme and antisense oligonucleotides see Rossi et al., supra.

In a preferred application of this invention, the polypeptide encoded by the gene is first identified, so that the effectiveness of antisense inhibition on translation can be monitored using techniques that include but are not limited to antibody-mediated tests such as RIAs and ELISA, functional assays, or radiolabeling.

The EST-related nucleic acids, positional segments of EST-related nucleic acids or fragments of positional segments of EST-related nucleic acids may also be used in gene therapy approaches based on intracellular triple helix formation. Triple helix oligonucleotides are used to inhibit transcription from a genome. They are particularly useful for studying alterations in cell activity as it is associated with a particular gene. The EST-related nucleic acids, positional segments of EST-related nucleic acids or fragments of positional segments of EST-related nucleic acids of the present invention or, more preferably, a portion of those sequences, can be used to inhibit gene expression in individuals having diseases associated with expression of a particular gene. Similarly, the EST-related nucleic acids, positional segments of EST-related nucleic acids or fragments of positional segments of EST-related nucleic acids can be used to study the effect of inhibiting transcription of a particular gene within a cell. Traditionally, homopurine sequences were considered the most useful for triple helix strategies. However, homopyrimidine sequences can also inhibit gene expression. Such homopyrimidine oligonucleotides bind to the major groove at homopurine:homopyrimidine sequences. Thus, both types of sequences from the EST-related nucleic acids, positional segments of EST-related nucleic acids or fragments of positional segments of EST-related nucleic acids are contemplated within the scope of this invention.

EXAMPLE 58

Preparation and Use of Triple Helix Probes

The sequences of the EST-related nucleic acids, positional segments of EST-related nucleic acids or fragments of positional segments of EST-related nucleic acids are scanned to identify 10-mer to 20-mer homopyrimidine or homopurine stretches which could be used in triple-helix based strategies for inhibiting gene expression. Following identification of candidate homopyrimidine or homopurine stretches, their efficiency in inhibiting gene expression is assessed by introducing varying amounts of oligonucleotides containing the candidate sequences into tissue culture cells which normally express the target gene. The oligonucleotides may be prepared on an oligonucleotide synthesizer or they may be purchased commercially from a company specializing in custom oligonucleotide synthesis, such as GENSET, Paris, France.

The oligonucleotides may be introduced into the cells using a variety of methods known to those skilled in the art, including but not limited to calcium phosphate precipitation, DEAE-Dextran, electroporation, liposome-mediated transfection or native uptake.

Treated cells are monitored for altered cell function or reduced gene expression using techniques such as Northern blotting, RNase protection assays, or PCR based strategies to monitor the transcription levels of the target gene in cells which have been treated with the oligonucleotide. The cell functions to be monitored are predicted based upon the homologies of the target genes corresponding to the EST-related nucleic acids, positional segments of EST-related nucleic acids or fragments of positional segments of EST-related nucleic acids from which the oligonucleotide were derived with known gene sequences that have been associated with a particular function. The cell functions can also be predicted based on the presence of abnormal physiologies within cells derived from individuals with a particular inherited disease, particularly when the EST-related nucleic acids, positional segments of EST-related nucleic acids or fragments of positional segments of EST-related nucleic acids are associated with the disease using techniques described herein.

The oligonucleotides which are effective in inhibiting gene expression in tissue culture cells may then be introduced in vivo using the techniques described above and in Example 56 at a dosage calculated based on the in vitro results, as described in Example 57.

In some embodiments, the natural (beta) anomers of the oligonucleotide units can be replaced with alpha anomers to render the oligonucleotide more resistant to nucleases. Further, an intercalating agent such as ethidium bromide, or the like, can be attached to the 3' end of the alpha oligonucleotide to stabilize the triple helix. For information on the generation of oligonucleotides suitable for triple helix formation see Griffin et al. (Science 245:967–971 (1989), the entire disclosure of which is incorporated herein by reference).

EXAMPLE 59

Use of EST-Related Nucleic Acids, Positional Segments of EST-Related Nucleic Acids or Fragments of Positional Segments of EST-related Nucleic Acids to Express an Encoded Protein in a Host Organism The EST-related nucleic acids, positional segments of EST-related nucleic acids or fragments of positional segments of EST-related nucleic acids may also be used to express an encoded protein or polypeptide in a host organism to produce a beneficial effect. In addition, nucleic acids encoding the EST-related polypeptides, positional segments of EST-related polypeptides or fragments of positional segments of EST-related polypeptides may be used to express the encoded protein or polypeptide in a host organism to produce a beneficial effect.

In such procedures, the encoded protein or polypeptide may be transiently expressed in the host organism or stably expressed in the host organism. The encoded protein or polypeptide may have any of the activities described above. The encoded protein or polypeptide may be a protein or polypeptide which the host organism lacks or, alternatively, the encoded protein may augment the existing levels of the protein in the host organism.

In some embodiments in which the protein or polypeptide is secreted, nucleic acids encoding the full length protein (i.e. the signal peptide and the mature protein), or nucleic acids encoding only the mature protein (i.e. the protein generated when the signal peptide is cleaved off) is introduced into the host organism.

The nucleic acids encoding the proteins or polypeptides may be introduced into the host organism using a variety of techniques known to those of skill in the art. For example, the extended cDNA may be injected into the host organism as naked DNA such that the encoded protein is expressed in the host organism, thereby producing a beneficial effect.

Alternatively, the nucleic acids encoding the protein or polypeptide may be cloned into an expression vector downstream of a promoter which is active in the host organism. The expression vector may be any of the expression vectors designed for use in gene therapy, including viral or retroviral vectors. The expression vector may be directly introduced into the host organism such that the encoded protein is expressed in the host organism to produce a beneficial effect. In another approach, the expression vector may be introduced into cells in vitro. Cells containing the expression vector are thereafter selected and introduced into the host organism, where they express the encoded protein or polypeptide to produce a beneficial effect.

EXAMPLE 60

Use of Signal Peptides to Import Proteins into Cells

The short core hydrophobic region (b) of signal peptides encoded by the sequences of SEQ ID NOs. 24–728 and 766–792 may also be used as a carrier to import a peptide or a protein of interest, so-called cargo, into tissue culture cells (Lin et al., *J. Biol. Chem.*, 270: 14225–14258 (1995); Du et al., *J. Peptide Res.*, 51: 235–243 (1998); and Rojas et al., *Nature Biotech.*, 16: 370–375 (1998), the entire disclosures of which are incorporated herein by reference).

When cell permeable peptides of limited size (approximately up to 25 amino acids) are to be translocated across cell membrane, chemical synthesis may be used in order to add the h region to either the C-terminus or the N-terminus to the cargo peptide of interest. Alternatively, when longer peptides or proteins are to be imported into cells, nucleic acids can be genetically engineered, using techniques familiar to those skilled in the art, in order to link the extended cDNA sequence encoding the h region to the 5' or the 3' end of a DNA sequence coding for a cargo polypeptide. Such genetically engineered nucleic acids are then translated either in vitro or in vivo after transfection into appropriate cells, using conventional techniques to produce the resulting cell permeable polypeptide. Suitable hosts cells are then simply incubated with the cell permeable polypeptide which is then translocated across the membrane.

This method may be applied to study diverse intracellular functions and cellular processes. For instance, it has been used to probe functionally relevant domains of intracellular proteins and to examine protein-protein interactions involved in signal transduction pathways (Lin et al., supra; Lin et al., *J. Biol. Chem.* 271: 5305–5308 (1996); Rojas et al., *J. Biol. Chem.*, 271: 2745627461 (1996); Liu et al., *Proc. Natl. Acad. Sci. USA*, 93: 11819–11824 (1996); Rojas et al. *Bioch. Biophys. Res. Commun.*, 234: 675680 (1997), the entire disclosure of which is incorporated herein by reference).

Such techniques may be used in cellular therapy to import proteins producing therapeutic effects. For instance, cells isolated from a patient may be treated with imported therapeutic proteins and then re-introduced into the host organism.

Alternatively, the h region of signal peptides of the present invention could be used in combination with a nuclear localization signal to deliver nucleic acids into cell nucleus. Such oligonucleotides may be antisense oligonucleotides or oligonucleotides designed to form triple helixes, as described above, in order to inhibit processing and maturation of a target cellular RNA.

EXAMPLE 61

Computer Embodiments

As used herein the term "nucleic acid codes of SEQ ID NOs. 24–811 and 1600–1622 encompasses the nucleotide sequences of SEQ ID NOs. 24–811 and 1600–1622, fragments of SEQ ID NOs. 24–811 and 1600–1622, nucleotide sequences homologous to SEQ ID NOs. 24–811 and 1600–1622 or homologous to fragments of SEQ ID NOs. 24–811 and 1600–1622, and sequences complementary to all of the preceding sequences. The fragments include portions of SEQ ID NOs. 24–811 and 1600–1622 comprising at least 10, 15, 20, 25, 30, 35, 40, 50, 75, 100, 150, 200, 300, 400, or 500 consecutive nucleotides of SEQ ID NOs. 24–811 and 1600–1622. Preferably, the fragments are novel fragments. Preferably the fragments include polynucleotides described in Table II, polynucleotides described in Table III, polynucleotides described in Table IV or portions thereof comprising at least 10, 15, 20, 25, 30, 35, 40, 50, 75, 100, 150, 200, 300, 400, or 500 consecutive nucleotides of the polynucleotides described in Tables II, III, or IV. Homologous sequences and fragments of SEQ ID NOs. 24–811 and 1600–1622 refer to a sequence having at least 99%, 98%, 97%., 96%, 95%, 90%, 85%, 80%, or 75% homology to these sequences. Homology may be determined using any of the computer programs and parameters described in Example 18, including BLAST2N with the default parameters or with any modified parameters. Homologous sequences also include RNA sequences in which uridines replace the thymines in the nucleic acid codes of SEQ ID NOs. 24–811 and 1600–1622. The homologous sequences may be obtained using any of the procedures described herein or may result from the correction of a sequencing error as described above. Preferably the homologous sequences and fragments of SEQ ID NOs. 24–811 and 1600–1622 include polynucleotides described in Table II, polynucleotides described in Table III, polynucleotides described in Table IV or portions thereof comprising at least 10, 15, 20, 25, 30, 35, 40, 50, 75, 100, 150, 200, 300, 400, or 500 consecutive nucleotides of the polynucleotides described in Tables II, III, or IV. It will be appreciated that the nucleic acid codes of SEQ ID NOs. 24–811 and 1600–1622 can be represented in the traditional single character format (See the inside back cover of Stryer, Lubert. *Biochemistry*, $3^4$ edition. W. H Freeman & Co., New York.) or in any other format which records the identity of the nucleotides in a sequence.

As used herein the term "polypeptide codes of SEQ ID NOS. 812–1599" encompasses the polypeptide sequence of SEQ ID) NOs. 812–1599 which are encoded by the 5' EST s of SEQ ID NOs. 24–811 and 1600–1622, polypeptide sequences homologous to the polypeptides of SEQ ID NOS. 812–1599, or fragments of any of the preceding sequences. Homologous polypeptide sequences refer to a polypeptide sequence having at least 990%, 98%, 97%, 96%, 95%, 900%, 85%, 80%, 75% homology to one of the polypeptide sequences of SEQ ID NOS. 812–1599. Homology may be determined using any of the computer programs and parameters described herein, including FASTA with the default parameters or with any modified parameters. The homologous sequences may be obtained using any of the procedures described herein or may result from the correction of a sequencing error as described above. The polypeptide fragments comprise at least 5, 10, 15, 20, 25, 30, 35, 40, 50, 75, 100, or 150 consecutive amino acids of the polypeptides of SEQ ID NOS. 812–1599. Preferably, the fragments are novel fragments. Preferably, the fragments include polypeptides encoded by the polynucleotides described in Table II, or portions thereof comprising at least 5, 10, 15, 20, 25, 30, 35, 40, 50, 75, 100, or 150 consecutive amino acids of the polypeptides encoded by the polynucleotides described in Table II. It will be appreciated that the polypeptide codes of the SEQ ID NOS. 812–1599 can be represented in the traditional single character format or three letter format (See the inside back cover of Stryer, Lubert. Biochemistry, 3rd edition. W. H Freeman & Co., New York.) or in any other format which relates the identity of the polypeptides in a sequence.

It will be appreciated by those skilled in the art that the nucleic acid codes of SEQ ID NOs. 24–811 and 1600–1622 and polypeptide codes of SEQ ID NOS. 812–1599 can be stored, recorded, and manipulated on any medium which can be read and accessed by a computer. As used herein, the words "recorded" and "stored" refer to a process for storing information on a computer medium. A skilled artisan can readily adopt any of the presently known methods for recording information on a computer readable medium to generate manufactures comprising one or more of the nucleic acid codes of SEQ ID NOs. 24–811 and 1600–1622, one or more of the polypeptide codes of SEQ ID NOS. 812–1599. Another aspect of the present invention is a computer readable medium having recorded thereon at least 2, 5, 10, 15, 20, 25, 30, or 50 nucleic acid codes of SEQ ID NOs. 24–811 and 1600–1622. Another aspect of the present invention is a computer readable medium having recorded thereon at least 2, 5, 10, 15, 20, 25, 30, or 50 polypeptide codes of SEQ ID NOS. 812–1599.

Computer readable media include magnetically readable media, optically readable media, electronically readable media and magnetic/optical media. For example, the computer readable media may be a hard disk, a floppy disk, a magnetic tape, CD-ROM, Digital Versatile Disk (DVD), Random Access Memory (RAM), or Read Only Memory (ROM) as well as other types of other media known to those skilled in the art.

Embodiments of the present invention include systems, particularly computer systems which store and manipulate the sequence information described herein. As used herein, "a computer system" refers to the hardware components, software components, and data storage components used to analyze the nucleotide sequences of the nucleic acid codes of SEQ ID NOs. 24–811 and 1600–1622, or the amino acid sequences of the polypeptide codes of SEQ ID NOS. 812–1599. In one embodiment, the computer system is a Sun Enterprise 1000 server (Sun Microsystems, Palo Alto, Calif.). The computer system preferably includes a processor for processing, accessing and manipulating the sequence data. The processor can be any well-known type of central processing unit, such as the Pentium III from Intel Corporation, or similar processor from Sun, Motorola, Compaq or International Business Machines.

Preferably, the computer system is a general purpose system that comprises the processor and one or more internal data storage components for storing data, and one or more data retrieving devices for retrieving the data stored on the data storage components. A skilled artisan can readily appreciate that any one of the currently available computer systems are suitable.

In one particular embodiment, the computer system includes a processor connected to a bus which is connected to a main memory (preferably implemented as RAM) and one or more internal data storage devices, such as a hard drive and/or other computer readable media having data recorded thereon. In some embodiments, the computer system further includes one or more data retrieving device for reading the data stored on the internal data storage devices.

The data retrieving device may represent, for example, a floppy disk drive, a compact disk drive, a magnetic tape drive, etc. In some embodiments, the internal data storage device is a removable computer readable medium such as a floppy disk, a compact disk, a magnetic tape, etc. Continuing control logic and/or data recorded thereon. The computer system may advantageously include or be programmed by appropriate software for reading the control logic and/or the data from the data storage component once inserted in the data retrieving device.

The computer system includes a display which is used to display output to a computer user. It should also be noted that the computer system can be linked to other computer systems in a network or wide area network to provide centralized access to the computer system.

Software for accessing and processing the nucleotide sequences of the nucleic acid codes of SEQ ID NOs. 24–811 and 1600–1622, or the amino acid sequences of the polypeptide codes of SEQ ID NOS. 812–1599 (such as search tools, compare tools, and modeling tools etc.) may reside in main memory during execution.

In some embodiments, the computer system may further comprise a sequence comparer for comparing the above-described nucleic acid codes of SEQ ID NOs. 24–811 and 1600–1622 or polypeptide codes of SEQ ID NOS. 812–1599 stored on a computer readable medium to reference nucleotide or polypeptide sequences stored on a computer readable medium. A "sequence comparer" refers to one or more programs which are implemented on the computer system to compare a nucleotide or polypeptide sequence with other nucleotide or polypeptide sequences and/or compounds including but not limited to peptides, peptidomimetics, and chemicals stored within the data storage means. For example, the sequence comparer may compare the nucleotide sequences of the nucleic acid codes of SEQ ID NOs. 24–811 and 1600–1622, or the amino acid sequences of the polypeptide codes of SEQ ID NOS. 812–1599 stored on a computer readable medium to reference sequences stored on a computer readable medium to identify homologies, motifs implicated in biological function, or structural motifs. The various sequence comparer programs identified elsewhere in this patent specification are particularly contemplated for use in this aspect of the invention.

One embodiment is a process for comparing a new nucleotide or protein sequence with a database of sequences in order to determine the homology levels between the new sequence and the sequences in the database. The database of sequences can be a private database stored within the computer system, or a public database such as GENBANK, PIR OR SWISSPROT that is available through the Internet.

The process begins at a start state and then moves to a state wherein the new sequence to be compared is stored to a memory in a computer system. As discussed above, the memory could be any type of memory, including RAM or an internal storage device.

The process then moves to a state wherein a database of sequences is opened for analysis and comparison. The process then moves to a state wherein the first sequence stored in the database is read into a memory on the computer. A comparison is then performed at a state to determine if the first sequence is the same as the second sequence. It is important to note that this step is not limited to performing an exact comparison between the new sequence and the first sequence in the database. Well-known methods are known to those of skill in the art for comparing two nucleotide or protein sequences, even if they are not identical. For example, gaps can be introduced into one sequence in order to raise the homology level between the two tested sequences. The parameters that control whether gaps or other features are introduced into a sequence during comparison are normally entered by the user of the computer system.

Once a comparison of the two sequences has been performed at the state, a determination is made at a decision state whether the two sequences are the same. Of course, the term "same" is not limited to sequences that are absolutely identical. Sequences that are within the homology parameters entered by the user will be marked as "same" in the process.

If a determination is made that the two sequences are the same, the process moves to a state wherein the name of the sequence from the database is displayed to the user. This state notifies the user that the sequence with the displayed name fulfills the homology constraints that were entered. Once the name of the stored sequence is displayed to the user, the process moves to a decision state wherein a determination is made whether more sequences exist in the database. If no more sequences exist in the database, then the process terminates at an end state. However, if more sequences do exist in the database, then the process moves to a state wherein a pointer is moved to the next sequence in the database so that it can be compared to the new sequence. In this manner, the new sequence is aligned and compared with every sequence in the database.

It should be noted that if a determination had been made at the decision state that the sequences were not homologous, then the process would move immediately to the decision state in order to determine if any other sequences were available in the database for comparison.

Accordingly, one aspect of the present invention is a computer system comprising a processor, a data storage device having stored thereon a nucleic acid code of SEQ ID NOs. 24–811 and 1600–1622 or a polypeptide code of SEQ ID NOS. 812–1599, a data storage device having retrievably stored thereon reference nucleotide sequences or polypeptide sequences to be compared to the nucleic acid code of SEQ ID NOs. 24–811 and 1600–1622 or polypeptide code of SEQ ID NOS. 812–1599 and a sequence comparer for conducting the comparison. The sequence comparer may indicate a homology level between the sequences compared or identify structural motifs in the above described nucleic acid code of SEQ ID NOs. 24–811 and 1600–1622 and polypeptide codes of SEQ ID NOS. 812–1599 or it may identify structural motifs in sequences which are compared to these nucleic acid codes and polypeptide codes. In some embodiments, the data storage device may have stored thereon the sequences of at least 2, 5, 10, 15, 20, 25, 30, or 50 of the nucleic acid codes of SEQ ID NOs. 24–811 and 1600–1622 or polypeptide codes of SEQ ID NOS. 812–1599.

Another aspect of the present invention is a method for determining the level of homology between a nucleic acid code of SEQ ID NOs. 24–811 and 1600–1622 and a reference nucleotide sequence, comprising the steps of reading the nucleic acid code and the reference nucleotide sequence through the use of a computer program which determines homology levels and determining homology between the nucleic acid code and the reference nucleotide sequence with the computer program. The computer program may be any of a number of computer programs for determining homology levels, including those specifically enumerated herein, including BLAST2N with the default parameters or with any modified parameters. The method may be implemented using the computer systems described above. The method may also be performed by reading 2, 5, 10, 15, 20, 25, 30, or 50 of the above described nucleic acid codes of SEQ ID NOs. 24–811 and 1600–1622 through use of the computer program and determining homology between the nucleic acid codes and reference nucleotide sequences.

One embodiment is a process in a computer for determining whether two sequences are homologous. The process begins at a start state and then moves to a state wherein a first sequence to be compared is stored to a memory. The second sequence to be compared is then stored to a memory at a state. The process then moves to a state wherein the first character in the first sequence is read and then to a state wherein the first character of the second sequence is read. It should be understood that if the sequence is a nucleotide sequence, then the character would normally be either A, T, C, G or U. If the sequence is a protein sequence, then it should be in the single letter amino acid code so that the first and sequence sequences can be easily compared.

A determination is then made at a decision state whether the two characters are the same. If they are the same, then the process moves to a state wherein the next characters in the first and second sequences are read. A determination is then made whether the next characters are the same. If they are, then the process continues this loop until two characters are not the same. If a determination is made that the next two characters are not the same, the process moves to a decision state to determine whether there are any more characters either sequence to read.

If there are no more more characters to read, then the process moves to a state wherein the level of homology between the first and second sequences is displayed to the user. The level of homology is determined by calculating the proportion of characters between the sequences that were the same out of the total number of sequences in the first sequence. Thus, if every character in a first 100 nucleotide sequence aligned with a every character in a second sequence, the homology level would be 100%.

Alternatively, the computer program may be a computer program which compares the nucleotide sequences of the nucleic acid codes of the present invention, to reference nucleotide sequences in order to determine whether the nucleic acid code of SEQ ID NOs. 24–811 and 1600–1622 differs from a reference nucleic acid sequence at one or more positions. Optionally such a program records the length and identity of inserted, deleted or substituted nucleotides with respect to the sequence of either the reference polynucleotides or the nucleic acid code of SEQ ID NOs. 24–811 and 1600–1622. In one embodiment, the computer program may be a program which determines whether the nucleotide sequences of the nucleic acid codes of SEQ ID NOs. 24–811 and 1600–1622 contain a biallelic marker or single nucleotide polymorphism (SNP) with respect to a reference nucleotide sequence. This single nucleotide polymorphism may comprise a single base substitution, insertion, or deletion, while this biallelic marker may comprise about one to ten consecutive bases substituted, inserted or deleted.

Another aspect of the present invention is a method for determining the level of homology between a polypeptide code of SEQ ID NOS. 812–1599 and a reference polypeptide sequence, comprising the steps of reading the polypeptide code of SEQ ID NOS. 812–1599 and the reference polypeptide sequence through use of a computer program which determines homology levels and determining homology between the polypeptide code and the reference polypeptide sequence using the computer program.

Accordingly, another aspect of the present invention is a method for determining whether a nucleic acid code of SEQ ID NOs. 24–811 and 1600–1622 differs at one or more nucleotides from a reference nucleotide sequence comprising the steps of reading the nucleic acid code and the reference nucleotide sequence through use of a computer program which identifies differences between nucleic acid sequences and identifying differences between the nucleic acid code and the reference nucleotide sequence with the computer program. In some embodiments, the computer program is a program which identifies single nucleotide polymorphisms. The method may be implemented by the computer systems described above. The method may also be performed by reading at least 2, 5, 10, 15, 20, 25, 30, or 50 of the nucleic acid codes of SEQ ID NOs. 24–811 and 1600–1622 and the reference nucleotide sequences through the use of the computer program and identifying differences between the nucleic acid codes and the reference nucleotide sequences with the computer program.

In other embodiments the computer based system may further comprise an identifier for identifying features within the nucleotide sequences of the nucleic acid codes of SEQ ID NOs. 24–811 and 1600–1622 or the amino acid sequences of the polypeptide codes of SEQ ID NOS. 812–1599.

An "identifier" refers to one or more programs which identifies certain features within the above-described nucleotide sequences of the nucleic acid codes of SEQ ID NOs. 24–811 and 1600–1622 or the amino acid sequences of the polypeptide codes of SEQ ID NOS. 812–1599. In one embodiment, the identifier may comprise a program which identifies an open reading frame in the cDNAs codes of SEQ ID NOs. 24–811 and 1600–1622.

One embodiment is an identifier process for detecting the presence of a feature in a sequence. The process begins at a start state and then moves to a state wherein a first sequence that is to be checked for features is stored to a memory in the computer system. The process then moves to a state wherein a database of sequence features is opened. Such a database would include a list of each feature's attributes along with the name of the feature. For example, a feature name could be "Initiation Codon" and the attribute would be "ATG". Another example would be the feature name "TAATAA Box" and the feature attribute would be "TAATAA". An example of such a database is produced by the University of Wisconsin Genetics Computer Group (www.gcg.com).

Once the database of features is opened at the state, the process moves to a state wherein the first feature is read from the database. A comparison of the attribute of the first feature with the first sequence is then made at a state. A determination is then made at a decision state whether the attribute of the feature is found in the first sequence. If the attribute was found, then the process moves to a state wherein the name of the found feature is displayed to the user.

The process then moves to a decision state wherein a determination is made whether move features exist in the database. If no more features do exist, then the process terminates at an end state. However, if more features do exist in the database, then the process reads the next sequence feature at a state and loops back to the state wherein the attribute of the next feature is compared against the first sequence.

It should be noted, that if the feature attribute is not found in the first sequence at the decision state, the process moves directly to the decision state in order to determine if any more features exist in the database.

In another embodiment, the identifier may comprise a molecular modeling program which determines the 3-dimensional structure of the polypeptides codes of SEQ ID NOS. 812–1599. In some embodiments, the molecular modeling program identifies target sequences that are most compatible with profiles representing the structural environments of the residues in known three-dimensional protein structures. (See, e.g., Eisenberg et al., U.S. Pat. No. 5,436,850 issued Jul. 25, 1995, the entire disclosure of which is incorporated herein by reference). In another technique, the known three-dimensional structures of proteins in a given family are superimposed to define the structurally conserved regions in that family. This protein modeling technique also uses the known three-dimensional structure of a homologous protein to approximate the structure of the polypeptide codes of SEQ ID NOS. 812–1599. (See e.g., Srinivasan, et al., U.S. Pat. No. 5,557,535 issued Sep. 17, 1996, the entire disclosure of which is incorporated herein by reference). Conventional homology modeling techniques have been used routinely to build models of proteases and antibodies. (Sowdhamini et al., Protein Engineering 10:207, 215 (1997), the entire disclosure of which is incorporated herein by reference). Comparative approaches can also be used to develop three-dimensional protein models when the protein of interest has poor sequence identity to template proteins. In some cases, proteins fold into similar three-dimensional structures despite having very weak sequence identities. For example, the three-dimensional structures of a number of helical cytokines fold in similar three-dimensional topology in spite of weak sequence homology.

The recent development of threading methods now enables the identification of likely folding patterns in a number of situations where the structural relatedness between target and template(s) is not detectable at the sequence level. Hybrid methods, in which fold recognition is performed using Multiple Sequence Threading (MST), structural equivalencies are deduced from the threading output using a distance geometry program DRAGON to construct a low resolution model, and a full-atom representation is constructed using a molecular modeling package such as QUANTA.

According to this 3-step approach, candidate templates are first identified by using the novel fold recognition algorithm MST, which is capable of performing simultaneous threading of multiple aligned sequences onto one or more 3-D structures. In a second step, the structural equivalencies obtained from the MST output are converted into interresidue distance restraints and fed into the distance geometry program DRAGON, together with auxiliary information obtained from secondary structure predictions. The program combines the restraints in an unbiased manner and rapidly generates a large number of low resolution model confirmations. In a third step, these low resolution model confirmations are converted into full-atom models and subjected to energy minimization using the molecular modeling package QUANTA. (See e.g., Aszodi et al., Proteins:Structure, Function, and Genetics, Supplement 1:38–42 (1997), the entire disclosure of which is incorporated herein by reference).

The results of the molecular modeling analysis may then be used in rational drug design techniques to identify agents which modulate the activity of the polypeptide codes of SEQ ID NOS. 812–1599.

Accordingly, another aspect of the present invention is a method of identifying a feature within the nucleic acid codes of SEQ ID NOs. 24–811 and 1600–1622 or the polypeptide codes of SEQ ID NOS. 812–1599 comprising reading the nucleic acid code(s) or the polypeptide code(s) through the use of a computer program which identifies features therein and identifying features within the nucleic acid code(s) or polypeptide code(s) with the computer program. In one embodiment, computer program comprises a computer program which identifies open reading frames. In a further embodiment, the computer program identifies structural motifs in a polypeptide sequence. In another embodiment, the computer program comprises a molecular modeling program. The method may be performed by reading a single sequence or at least 2, 5, 10, 15, 20, 25, 30, or 50 of the nucleic acid codes of SEQ ID NOs. 24–811 and 1600–1622 or the polypeptide codes of SEQ ID NOS. 812–1599 through the use of the computer program and identifying features within the nucleic acid codes or polypeptide codes with the computer program.

The nucleic acid codes of SEQ ID NOs. 24–811 and 1600–1622 or the polypeptide codes of SEQ ID NOS. 812–1599 may be stored and manipulated in a variety of data processor programs in a variety of formats. For example, the nucleic acid codes of SEQ ID NOs. 24–811 and 1600–1622 or the polypeptide codes of SEQ ID NOS. 812–1599 may be stored as text in a word processing file, such as MicrosofRWORD or WORDPERFECT or as an ASCII file in a variety of database programs familiar to those of skill in the art, such as DB2, SYBASE, or ORACLE. In addition, many computer programs and databases may be used as sequence comparers, identifiers, or sources of reference nucleotide or polypeptide sequences to be compared to the nucleic acid codes of SEQ ID NOs. 24–811 and 1600–1622 or the polypeptide codes of SEQ ID NOS. 812–1599. The following list is intended not to limit the invention but to provide guidance to programs and databases which are useful with the nucleic acid codes of SEQ ID NOs. 24–811and 1600–1622 or the polypeptide codes of SEQ ID NOS. 812–1599. The programs and databases which may be used include, but are not limited to: MacPattern (EMBL), DiscoveryBase (Molecular Applications Group), GeneMine (Molecular Applications Group), Look (Molecular Applications Group), MacLook (Molecular Applications Group), BLAST and BLAST2 (NCBI), BLASTN and BLASTX (Altschul et al, *J. Mol. Biol.* 215: 403 (1990)), FASTA (Pearson and Lipman, *Proc. Natl. Acad. Sci. USA*, 85: 2444 (1988)), FASTDB (Brutlag et al. Comp. App. Biosci. 6:237–245, 1990), Catalyst (Molecular Simulations Inc.), Catalyst/SHAPE (Molecular Simulations Inc.), Cerius$^2$.DBAccess (Molecular Simulations Inc.), HypoGen (Molecular Simulations Inc.), Insight II, (Molecular Simulations Inc.), Discover (Molecular Simulations Inc.), CHARMm (Molecular Simulations Inc.), Felix (Molecular Simulations Inc.), DelPhi, (Molecular Simulations Inc.), QuanteMM, (Molecular Simulations Inc.), Homology (Molecular Simulations Inc.), Modeler (Molecular Simulations Inc.), ISIS (Molecular Simulations Inc.), Quanta/ Protein Design (Molecular Simulations Inc.), WebLab (Molecular Simulations Inc.), WebLab Diversity Explorer (Molecular Simulations Inc.), Gene Explorer (Molecular Simulations Inc.), SeqFold (Molecular Simulations Inc.), the EMBL/Swissprotein database, the MDL Available Chemicals Directory database, the MDL Drug Data Report data base, the Comprehensive Medicinal Chemistry database, Derwents's World Drug Index database, the BioByteMasterFile database, the Genbank database, and the Genseqn database. Many other programs and databases would be apparent to one of skill in the art given the present disclosure.

Motifs which may be detected using the above programs include sequences encoding leucine zippers, helix-turn-helix motifs, glycosylation sites, ubiquitination sites, alpha helices, and beta sheets, signal sequences encoding signal peptides which direct the secretion of the encoded proteins, sequences implicated in transcription regulation such as homeoboxes, acidic stretches, enzymatic active sites, substrate binding sites, and enzymatic cleavage sites.

EXAMPLE 62

Methods of Making Nucleic Acids

The present invention also comprises methods of making the EST-related nucleic acids, fragments of EST-related nucleic acids, positional segments of the EST-related nucleic acids, or fragments of positional segments of the EST-related nucleic acids. The methods comprise sequentially linking together nucleotides to produce the nucleic acids having the preceding sequences. A variety of methods of synthesizing nucleic acids are known to those skilled in the art.

In many of these methods, synthesis is conducted on a solid support. These included the 3' phosphoramidite methods in which the 3' terminal base of the desired oligonucleotide is immobilized on an insoluble carrier. The nucleotide base to be added is blocked at the 5' hydroxyl and activated at the 3' hydroxyl so as to cause coupling with the immobilized nucleotide base. Deblocking of the new immobilized nucleotide compound and repetition of the cycle will produce the desired polynucleotides. Alternatively, polynucleotides may be prepared as described in U.S. Pat. No. 5,049,656. In some embodiments, several polynucleotides prepared as described above are ligated together to generate longer polynucleotides having a desired sequence.

EXAMPLE 63

Methods of Making Polypeptides

The present invention also comprises methods of making the polynucleotides encoded by EST-related nucleic acids, fragments of EST-related nucleic acids, positional segments of the EST-related nucleic acids, or fragments of positional segments of the EST-related nucleic acids and methods of making the EST-related polypeptides, fragments of EST-related polypeptides, positional segments of EST-related polypeptides, or fragments of EST-related polypeptides. The methods comprise sequentially linking together amino acids to produce the nucleic polypeptides having the preceding sequences. In some embodiments, the polypeptides made by these methods are 150 amino acid or less in length. In other embodiments, the polypeptides made by these methods are 120 amino acids or less in length.

A variety of methods of making polypeptides are known to those skilled in the art, including methods in which the carboxyl terminal amino acid is bound to polyvinyl benzene or another suitable resin. The amino acid to be added possesses blocking groups on its amino moiety and any side chain reactive groups so that only its carboxyl moiety can react. The carboxyl group is activated with carbodiimide or another activating agent and allowed to couple to the immobilized amino acid. After removal of the blocking group, the cycle is repeated to generate a polypeptide having the desired sequence. Alternatively, the methods described in U.S. Pat. No. 5,049,656, the entire disclosure of which is incorporated herein by reference, may be used.

As discussed above, the EST-related nucleic acids, fragments of the EST-related nucleic acids, positional segments of the EST-related nucleic acids, or fragments of positional segments of the EST-related nucleic acids can be used for various purposes. The polynucleotides can be used to express recombinant protein for analysis, characterization or therapeutic use; production of secreted polypeptides or chimeric polypeptides, antibody production, as markers for tissues in which the corresponding protein is preferentially expressed (either constitutively or at a particular stage of tissue differentiation or development or in disease states); as molecular weight markers on Southern gels; as chromosome markers or tags (when labeled) to identify chromosomes or to map related gene positions; to compare with endogenous DNA sequences in patients to identify potential genetic disorders; as probes to hybridize and thus discover novel, related DNA sequences; as a source of information to derive PCR primers for genetic fingerprinting; for selecting and making oligomers for attachment to a "gene chip" or other support, including for examination for expression patterns; to raise anti-protein antibodies using DNA immunization techniques; and as an antigen to raise anti-DNA antibodies or elicit another immune response. Where the polynucleotides encodes a protein or polypeptide which binds or potentially binds to another protein or polypeptide (such as, for example, in a receptor-ligand interaction), the polynucleotides can also be used in interaction trap assays (such as, for example, that described in Gyuris et al., Cell 75:791–803 (1993), the entire disclosure of which is incorporated herein by reference) to identify polynucleotides encoding the other protein or polypeptide with which binding occurs or to identify inhibitors of the binding interaction.

The proteins or polypeptides provided by the present invention can similarly be used in assays to determine biological activity, including in a panel of multiple proteins for high-throughput screening; to raise antibodies or to elicit another immune response; as a reagent (including as a labeled reagent) in assays designed to quantitatively determine levels of the protein (or its receptor) in biological fluids; as markers for tissues in which the corresponding protein is preferentially expressed (either constitutively or at a particular stage of tissue differentiation or development or in a disease state); and, of course, to isolate correlative receptors or ligands. Where the protein or potypeptide binds or potentially binds to another protein or polypeptide (such as, for example, in a receptor-ligand interaction), the protein can be used to identify the other protein with which binding occurs or to identify inhibitors of the binding interaction. Proteins or polypeptides involved in these binding interactions can also be used to screen for peptide or small molecule inhibitors or agonists of the binding interaction.

Any or all of these research utilities are capable of being developed into reagent grade or kit format for commercialization as research products.

Methods for performing the uses listed above are well known to those skilled in the art. References disclosing such methods include without limitation "Molecular Cloning; A Laboratory Manual," 2d ed., Cold Spring Harbor Laboratory Press, Sambrook, J., E. F. Fritsch and T. Maniatis eds., 1989, and "Methods in Enzymology; Guide to Molecular Cloning Techniques," Academic Press, Berger, S. L. and A. R. Kimmel eds., 1987, the entire disclosures of which are incorporated herein by reference.

Polynucleotides and proteins or polypeptides of the present invention can also be used as nutritional sources or supplements. Such uses include without limitation use as a protein or amino acid supplement, use as a carbon source, use as a nitrogen source and use as a source of carbohydrate. In such cases the protein or polynucleotides of the invention can be added to the feed of a particular organism or can be administered as a separate solid or liquid preparation, such as in the form of powder, pills, solutions, suspensions or capsules. In the case of microorganisms, the protein or polynucleotides of the invention can be added to the medium in or on which the microorganism is cultured.

Although this invention has been described in terms of certain preferred embodiments, other embodiments which will be apparent to those of ordinary skill in the art in view of the disclosure herein are also within the scope of this invention. Accordingly, the scope of the invention is intended to be limited only by reference to the appended claims.

SEQUENCE LISTING (1622 sequences)

SEQ ID NO: 1 - DNA, 822 bp, Homo Sapiens
  CDS 346..552
  sig_peptide 346..408: Von Heijne matrix
  misc_feature 115: n=a, g, c or t Oligonucleotide
actccttttagcataggggcttcggcgccagcggccagcgctagtcggtctggtaagtgcctgatgccgagttccgtctctcgcgtcttttcctggtcccaggcaaagcggasgnagatcctcaaacggcctagtgcttcgcgcttccggagaaaatcagcggtctaattaattcctctggtttgttgaagcagttaccaagaatcttcaaccctttcccacaaaagctaattgagtacacgttcctgttgagtacacgttcctgttgatttacaaaaggtgcaggtatgagcaggtctgaagactaacattttgtgaagttgtaaaacagaaaacctgttagaaatgtggtggtttcagcaaggcctcagtttccttccttcagcccttgtaatttggacatctgctgctttcatattttcatacattactgcagtaacactccaccatatagacccggctttaccttatatcagtgacactggtacagtagctccaraaaaatgcttatttggggcaatgctaaatattgcggcagttttatgtcaaaaatagaaatcaggaarataattcaacttaaagaakttcatttcatgaccaaactcttcaraaacatgtctttacaagcatatctcttgtattgctttctacactgttgaattgtctggcaatatttctgcagtggaaaatttgatttarmtagttcttgactgataaatatggtaaggtgggcttttccccctgtgtaattggctactatgtcttactgagccaagttgtawtttgaaataaaatgatatgagagtgacacaaaaaaaaaaa

SEQ ID NO: 2 - protein, 21 aa, Homo Sapiens
  SIGNAL 1..21: Von Heijne matrix score 5.5 seq SFLPSALVIWTSA/AF
MWWFQQGLSFLPSALVIWTSA

SEQ ID NO: 3 - DNA, 526 bp, Homo Sapiens
  CDS 90..344
  sig_peptide 90..140: Von Heijne matrix
  misc_feature 290: n=a, g, c or t Oligonucleotide
aatatraracagctacaatattccagggccartcacttgccatttctcataacagcgtcagagagaaagaactgactgaracgtttgagatgaagaaagttctcctcctgatcacagccatcttggcagtggctgtwggtttcccagtctctcaagaccaggaacgagaaaaaagaagtatcagtgacagcgatgaattagcttcaggrwtttttgtgttcccttacccatatccatttcgcccacttccaccaattccatttccaagatttccatggtttagacgtaantttcctattccaatacctgaatctgcccctacaactccccttcctagcgaaaagtaaacaaraaggaaaagtcacrataaacctggtcacctgaaattgaaattgagccacttccttgaaraatcaaaattcctgttaataaaaraaaaacaaatgtaattgaaatagcacacagcattctctagtcaatatctttagtgatcttctttaataaacatgaaagcaaaaaaaaaaaa

SEQ ID NO: 4 - protein, 17 aa, Homo Sapiens
  SIGNAL 1..17: Von Heijne matrix score 8.2 seq LLLITAILAVAVG/FP
MKKVLLLITAILAVAVG

SEQ ID NO: 5 - DNA, 848 bp, Homo Sapiens
  CDS 32..697
  sig_peptide 32..73: Von Heijne matrix
aactttgccttgtgttttccaccctgaaagaatgttgtggctgctcttttttctggtgactgccattcatgctgaactctgtcaaccaggtgcagaaaatgcttttaaagtgagacttagtatcagaacagctctgggagataaagcatatgcctgggataccaatgaagaatacctcttcaaagcgatggtagctttctccatgagaaaagttcccaacagagaagcaacagaaatttcccatgtcctactttgcaatgtaacccagagggtatcattctggtttgtggttacagacccttcaaaaaatcacacccttcctgctgttgaggtgcaatcagccataagaatgaacaagaaccggatcaacaatgccttctttctaaatgaccaaactctggaatttttaaaaatcccttccacacttgcaccacccatggacccatctgtgcccatctggattattatatttggtgtgatattttgcatcatcatagttgcaattgcactactgattttatcagggatctggcaacgtadaaraaagaacaaagaaccatctgaagtggatgacgctgaarataaktgtgaaaacatgatcacaattgaaaatggcatcccctctgatcccctggacatgaagggagggcatattaatgatgccttcatgacagaggatgagaggctcacccctctctgaagggctgttgttctgcttcctcaaraaattaaacatttgtttctgtgtgactgctgagcatcctgaaataccaagagcagatcatatwttttgtttcaccattcttcttttgtaataaattttgaatgtgcttgaaaaaaaaaaaaac

SEQ ID NO: 6 - protein, 14 aa, Homo Sapiens
  SIGNAL 1..14: Von Heijne matrix score 10.7 seq LWLLFFLVTAIHA/EL
MLWLLFFLVTAIHA

SEQ ID NO: 7 - DNA, 826 bp, Homo sapiens
  CDS 15..695
  sig_peptide 15..80: score 8.5 seq AALLLGLMMVVTG/DE
aaccagaggtgcccatgggttggacaatgaggctggtcacagcagcactgttactgggtctcatgatggtggtcactggagacgaggatgagaacagcccgtgtgcccatgaggccctcctggacgaggacaccctcttttgccagggccttgaagttttctacccagagttggggaacattggctgcaaggttgttcctgattgtaacaactacagacagaagatcacctcctggatggagccgatagtcaagttcccgggggccgtggacggcgcaacctatatcctggtgatggtggatccagatgcccctagcagagcagaacccagacagagattctggagacattggctggtaacagatatcaagggcgccgacctgaagaaagggaagattcagggccaggagttatcagcctaccaggctccctccccaccggcacacagtggcttccatcgctaccagttctttgtctatcttcaggaaggaaaggtcatctctctccttcccaaggaaaacaaaactcgaggctcttggaaaatggacagatttctgaaccgtttccacctgggcgaacctgaagcaagcacccagttcatgacccagaactaccaggactcaccaaccctccaggctcccagagaaagggccagcgagcccaagcacaaaaaccaggcggagatagctgcctgctagatagccggctttgccatccgggcatgtggccacactgcccaccaccgacgatgtgggtatggaaccccctctggatacagaaccccttcttttccaaataaaaaaaaaatcatccaaaaaaaaaaaaa

SEQ ID NO: 8 - protein, 227 aa, Homo sapiens
  SIGNAL -22..-1: score 8.5 seq AALLLGLMMVVTG/DE
MGWTMRLVTAALLLGLMMVVTGDEDENSPCAHEALLDEDTLFCQGLEVFYPELGNIGCKVVPDCNNYRQKITSWMEPIVKFPGAVDGATYILVMVDPDAPSRAEPRQRFWRHWLVTDIKGADLKKGKIQGQELSAYQAPSPPAHSGFHRYQFFVYLQEGKVISLLPKENKTRGSWKMDRFLNRFHLGEPEASTQFMTQNYQDSPTLQAPRERASEPKHKNQAEIAAC

SEQ ID NO: 9 - DNA, 852 bp, Homo sapiens
  CDS 229..735
  sig_peptide 229..492: score 6.7 seq VFALSSFLNKASA/VY
aatgactggcagtggcatcagcgatggcggctgcgtcggggtcggttctgcagcgctgtatcgtgtcgccggcagggaggcatagcgcctctctgatcttcctgcatggctcaggtgattctggacaaggattaagaatgtggatcaagcaggtttttaaatcaagatttaacattccaacacataaaaattatttatccaacagctcctcccagatcatatactcctatgaaaggaggaatctccaatgtatggtttgacagatttaaaataaccaatgactgcccagaacaccttgaatcaattgatgtcatgtgtcaagtgcttactgatttgattgatgaagaagtaaaaagtggcatcaagaagaacaggatattaataggaggattctctatgggaggatgcatggcaatgcatttagcatatagaaatcatcaagatgtggcaggagtatttgctctttctagttttctgaataaagcatctgctgtttaccaggctcttcagaagagtaatggtgtacttcctgaattatttcagtgtcatggtactgcagatgagttagttcttcattcttgggcagaagagacaaactcaatgttaaaatctctaggagtgaccacgaagtttcatagttttccaaatgtttaccatgagctaagcaaaactgagttagacatattgaagttatggattcttacaaagctgccaggagaaatggaaaaacaaaaatgaatgaatcaagagtgatttgttaatgtaagtgtaatgtctttgtgaaaagtgatttttactgccaaattataatgataattaaaatattaagaaatagcaaaaaaaaaaaaaaaa

SEQ ID NO: 10 - protein, 169 aa, Homo sapiens [sequence omitted]

SEQ ID NO: 11 - DNA, 1602 bp, Homo sapiens
  CDS 24..1004
  sig_peptide 24..170: score 5.6 seq ACLSLGFFSLLWL/QL
atgcgccgccgcctctccgcacgatgttcccctcgcggaggaaagcggcgcagctgccctgggaggacggcaggtccgggttgctctccggcggcctccctcggaagtgttccgtcttccacctgttcgtggcctgcctctcgctgggcttcttctccctactctggctgcagctcagctgctctggggacgtggcccgggcagtcaggggacaagggcaggagacctcgggccctccccgtgcctgccccccagagccgccccctgagcactgggaagaagacgcatcctggggcccccaccgcctggcagtgctggtgcccttccgcgaacgcttcgaggagctcctggtcttcgtgccccacatgcgccgcttcctgagcaggaagaagatccggcaccacatctacgtgctcaaccaggtggaccacttcaggttcaaccgggcagcgctcatcaacgtgggcttcctggagagcagcaacagcacggactacattgccatgcacgacgttgacctgctccctctcaacgaggagctggactatggctttcctgaggctgggcccttccacgtggcctccccggagctccaccctctctaccactacaagacctatgtcggcggcatcctgctgctctccaagcagcactaccggctgtgcaatgggatgtccaaccgcttctggggctggggccgcgaggacgacgagttctaccggcgcattaagggagctgggctccagcttttccgcccctcgggaatcacaactgggtacaagacatttcgccacctgcatgacccagcctggcggaagagggaccagaagcgcatcgcagctcaaaaacaggagcagttcaaggtggacagggagggaggcctgaacactgtgaagtaccatgtggcttcccgcactgccctgtctgtgggcggggccccctgcactgtcctcaacatcatgttggactgtgacaagaccgccacaccctggtgcacattcagctgagctggatggacagtgaggaagcctgtacctacaggccatattgctcaggctcaggacaaggcctcaggtcgtgggcccagctctgacaggatgtggagtggccaggaccaagacagcaagctacgcaattgcagccacccggccgccaaggcaggcttgggctgggccaggacacgtggggtgcctgggacgctgcttgccatgcacagtgatcagagagaggctggggtgtgtcctgtccgggaccccccctgccttcctgctcaccctactctgacctccttcacgtgcccaggcctgtgggtagtggggagggctgaacaggacaacctctcatcacccccacttttgttccttcctgctgggctgcctcgtgcagagacacagtgtaggggccatgcagctggcgtaggtggcagttgggcctggtgagggttaggacttcagaaaccagagcacaagccccacagagggggaacagccagcaccgctctagctggttgttgccatgccggaatgtgggcctagtgttgccagatcttctgatttttcgaaagaaactagaatgctggattctcaaaaaaaaaaaaaaaaa

SEQ ID NO: 12 - protein, 327 aa, Homo sapiens
  SIGNAL -49..-1: score 5.6 seq ACLSLGFFSLLWL/QL
MFPSRRKAAQLPWEDGRSGLLSGGLPRKCSVFHLFVACLSLGFFSLLWLQLSCSGDVARAVRGQGQETSGPPRACPPEPPPEHWEEDASWGPHRLAVLVPFRERFEELLVFVPHMRRFLSRKKIRHHIYVLNQVDHFRFNRAALINVGFLESSNSTDYIAMHDVDLLPLNEELDYGFPEAGPFHVASPELHPLYHYKTYVGGILLLSKQHYRLCNGMSNRFWGWGREDDEFYRRIKGAGLQLFRPSGITTGYKTFRHLHDPAWRKRDQKRIAAQKQEQFKVDREGGLNTVKYHVASRTALSVGGAPCTVLNIMLDCDKTATPWCTFS

SEQ ID NO: 13 - DNA, 1568 bp, Homo sapiens
  CDS 75..1259
  sig_peptide 75..1004: score 4.4 seq VLILLFSLALIIL/PS
agaaaaggtgtagtgtttggggcggtcaacgggctatgctggcttgacagggctgggctcttcagaacagaagcatggatctcggaatccctgacctgctggacgcgtggctggagcccccagaggatatcttctcgacaggatccgtcctggagctgggactccactgcccccctccagaggttccggtaactaggctacaggaacagggactgcaaggctggaagtccggtggggaccgtggctgtggccttcaagagagtgagcctgaagatttcttgaagcttttcattgatcccaatgaggtgtactgctcagaagcatctcctggcagtgacagtggcatctctgaggactcctgccatccagacagtccccctgcccccagggcaaccagttctcctatgctctatgaggttgtctatgaggcaggggccctggagaggatgcagggggaaactgggccaaatgtaggccttatctccatccagctagatcagtggagcccagcatttatggtgcctgattcctgcatggtcagtgagctgccctttgatgctcatgcccacatcctgcccagagcaggcaccgtagccccagtgccctgtacaaccctgctgccctgtcaaaccctgttcctgaccgatgaggagaagcgtctgctggggcaggaaggggtttccctgccctctcacctgcccctcaccaaggcagaggagagggtcctcaagaaggtcaggaggaaaatccgtaacaagcagtcagctcaggacagtcggcggcggaagaaggagtacattgatgggctggagagcagggtggcagcctgttctgcacagaaccaagaattacagaaaaaagtccaggagctggagaggcacaacatctccttggtagctcagctccgccagctgcagacgctaattgctcaaacttccaacaaagctgcccagaccagcacttgtgttttgattcttcttttttccctggctctcatcatcctgcccagcttcagtccattccagagtcgaccagaagctgggtctgaggattaccagcctcacggagtgacttccagaaatatcctgacccacaaggacgtaacagaaaatctggagacccaagtggtagagtccagactgagggagccacctggagccaaggatgcaaatggctcaacaaggacactgcttgagaagatgggagggaagccaagacccagtgggcgcatccggtccgtgctgcatgcagatgagatgtgagctggaacagaccttcctggcccacttcctgatcacaaggaatcctgggcttccttatggctttcttcccactgggattcctacttaggtgtctgccctcaggggtccaaatcacttcaggacaccccaagagatgtcctttagtctctgcctgaggcctagtctgcatttgtttgcatatatgagagggtacctcaaatacttctgttatgtatctgtgattttatttcttctttgggtatagggttgaggggaaataagttttgagtgagaaataaacgttttagctgaaaaaaaaaaaaaaaa

SEQ ID NO: 14 - protein, 395 aa, Homo sapiens [sequence omitted]

SEQ ID NO: 15 - DNA, 25 bp, Artificial Sequence
gggaagatggagatagtattgcctg

SEQ ID NO: 16 - DNA, 26 bp, Artificial Sequence
ctgccatgtacatgatagagagattc

SEQ ID NO: 17 - DNA, 546 bp, Homo Sapiens
  promoter 1..517
  transcription start site 518
  protein_bind 17..25: matinspector prediction name CMYB_01 score 0.983 sequence tgtcagttg
  protein_bind complement(18..27): matinspector prediction name MYOD_Q6 score 0.961 sequence cccaactgac
  protein_bind complement(75..85): matinspector prediction name S8_01 score 0.960 sequence aatagaattag
  protein_bind 94..104: matinspector prediction name S8_01 score 0.966 sequence aactaaattag
  protein_bind complement(129..139): matinspector prediction name DELTAEF1_01 score 0.960 sequence gcacacctcag
  protein_bind complement(155..165): matinspector prediction name GATA_C score 0.964 sequence agataaatcca
  protein_bind 170..178: matinspector prediction name CMYB_01 score 0.958 sequence cttcagttg
  protein_bind 176..189: matinspector prediction name GATA1_02 score 0.959 sequence ttgtagataggaca
  protein_bind 180..190: matinspector prediction name GATA_C score 0.953 sequence agataggacat
  protein_bind 284..299: matinspector prediction name TAL1ALPHAE47_01 score 0.973 sequence cataacagatggtaag
  protein_bind 284..299: matinspector prediction name TAL1BETAE47_01 score 0.983 sequence cataacagatggtaag
  protein_bind 284..299: matinspector prediction name TAL1BETAITF2_01 score 0.978 sequence cataacagatggtaag
  protein_bind complement(287..296): matinspector prediction name MYOD_Q6 score 0.954 sequence accatctgtt
  protein_bind complement(302..314): matinspector prediction name GATA1_04 score 0.953 sequence tcaagataaagta
  protein_bind 393..405: matinspector prediction name IK1_01 score 0.963 sequence agttgggaattcc
  protein_bind 393..404: matinspector prediction name IK2_01 score 0.985 sequence agttgggaattc
  protein_bind 396..405: matinspector prediction name CREL_01 score 0.962 sequence tgggaattcc
  protein_bind 423..436: matinspector prediction name GATA1_02 score 0.950 sequence tcagtgatatggca
  protein_bind complement(478..489): matinspector prediction name SRY_02 score 0.951 sequence taaaacaaaaca
  protein_bind 486..493: matinspector prediction name E2F_02 score 0.957 sequence tttagcgc
  protein_bind complement(514..521): matinspector prediction name MZF1_01 score 0.975 sequence tgagggga
tgagtgcagtgttacatgtcagttgggttaagtttgttaatgtcattcaaatcttctatgtcttgatttgcctgctaattctattatttctggaactaaattagtttgatggttctattagttattgactgaggtgtgctaatctcccattatgtggatttatctatttcttcagttgtagataggacattgatagatacataagtaccaggacaaaagcagggagatcttttttccaaaatcaggagaaaaaaatgacatctggaaaacctatagggaaaggcataacagatggtaaggatactttatcttgagtaggagagccttcctgtggcaacgtggagaagggaagaggtcgtagaattgaggagtcagctcagttagaagcagggagttgggaattccgttcatgtgatttagcatcagtgatatggcaaatgtgggactaagggtagtgatcagagggttaaaattgtgtgttttgttttagcgctgctggggcatcgccttgggtcccctcaaacagattcccatgaatctcttcat

SEQ ID NO: 18 - DNA, 23 bp, Artificial Sequence
gtaccagggactgtgaccattgc

SEQ ID NO: 19 - DNA, 24 bp, Artificial Sequence
ctgtgaccattgctcccaagagag

SEQ ID NO: 20 - DNA, 861 bp, Homo Sapiens
  promoter 1..806
  transcription start site 807
  protein_bind complement(60..70): matinspector prediction name NFY_Q6 score 0.956 sequence ggaccaatcat
  protein_bind 70..77: matinspector prediction name MZF1_01 score 0.962 sequence cctgggga
  protein_bind 124..132: matinspector prediction name CMYB_01 score 0.994 sequence tgaccgttg
  protein_bind complement(126..134): matinspector prediction name VMYB_02 score 0.985 sequence tccaacggt
  protein_bind 135..143: matinspector prediction name STAT_01 score 0.968 sequence ttcctggaa
  protein_bind complement(135..143): matinspector prediction name STAT_01 score 0.951 sequence ttccaggaa
  protein_bind complement(252..259): matinspector prediction name MZF1_01 score 0.956 sequence ttggggga
  protein_bind 357..368: matinspector prediction name IK2_01 score 0.965 sequence gaatgggatttc
  protein_bind 384..391: matinspector prediction name MZF1_01 score 0.986 sequence agagggga
  protein_bind complement(410..421): matinspector prediction name SRY_02 score 0.955 sequence gaaaacaaaaca
  protein_bind 592..599: matinspector prediction name MZF1_01 score 0.960 sequence gaagggga
  protein_bind 618..627: matinspector prediction name MYOD_Q6 score 0.981 sequence agcatctgcc
  protein_bind 632..642: matinspector prediction name DELTAEF1_01 score 0.958 sequence tcccaccttcc
  protein_bind complement(813..823): matinspector prediction name S8_01 score 0.992 sequence gaggcaattat
  protein_bind complement(824..831): matinspector prediction name MZF1_01 score 0.986 sequence agagggga
  misc_feature 335,376: n=a, g, c or t Oligonucleotide
tactatagggcacgcgtggtcgacggccgggctgttctggagcagagggcatgtcagtaatgattggtccctggggaaggtctggctggctccagcacagtgaggcatttaggtatctctcggtgaccgttggattcctggaagcagtagctgttctgtttggatctggtagggacagggctcagagggctaggcacgagggaaggtcagaggagaaggsaggsarggcccagtgagargggagcatgccttcccccaaccctggcttscycttggymamagggcgkttytgggmacttraaytcagggcccaascagaascacaggcccaktcntggctsmaagcacaatagcctgaatgggatttcaggttagncagggtgagaggggaggctctctggcttagttttgttttgttttccaaatcaaggtaacttgctcccttctgctacgggccttggtcttggcttgtcctcacccagtcggaactccctaccactttcaggagagtggttttaggcccgtggggctgttctgttccaagcagtgtgagaacatggctggtagaggctctagctgtgtgcggggcctgaaggggagtgggttctcgcccaaagagcatctgcccatttcccaccttcccttctcccaccagaagcttgcctgagctgtttggacaaaaatccaaaccccacttggctactctggcctggcttcagcttggaacccaatacctaggcttacaggccatcctgagccaggggcctctggaaattctcttcctgatggtcctttaggtttgggcacaaaatataattgcctctcccctctcccattttctctcttgggagcaatggtcac

SEQ ID NO: 21 - DNA, 20 bp, Artificial Sequence
ctgggatggaaggcacggta

SEQ ID NO: 22 - DNA, 20 bp, Artificial Sequence
gagaccacacagctagacaa

SEQ ID NO: 23 - DNA, 555 bp, Homo Sapiens
  promoter 1..500
  transcription start site 501
  protein_bind 191..206: matinspector prediction name ARNT_01 score 0.964 sequence ggactcacgtgctgct
  protein_bind 193..204: matinspector prediction name NMYC_01 score 0.965 sequence actcacgtgctg
  protein_bind 193..204: matinspector prediction name USF_01 score 0.985 sequence actcacgtgctg
  protein_bind complement(193..204): matinspector prediction name USF_01 score 0.985 sequence cagcacgtgagt
  protein_bind complement(193..204): matinspector prediction name NMYC_01 score 0.956 sequence cagcacgtgagt
  protein_bind complement(193..204): matinspector prediction name MYCMAX_02 score 0.972 sequence cagcacgtgagt
  protein_bind 195..202: matinspector prediction name USF_C score 0.997 sequence tcacgtgc
  protein_bind complement(195..202): matinspector prediction name USF_C score 0.991 sequence gcacgtga
  protein_bind complement(210..217): matinspector prediction name MZF1_01 score 0.968 sequence catgggga
  protein_bind 397..410: matinspector prediction name ELK1_02 score 0.963 sequence ctctccggaagcct
  protein_bind 400..409: matinspector prediction name CETS1P54_01 score 0.974 sequence tccggaagcc
  protein_bind complement(460..470): matinspector prediction name AP1_Q4 score 0.963 sequence agtgactgaac
  protein_bind complement(460..470): matinspector prediction name AP1FJ_Q2 score 0.961 sequence agtgactgaac
  protein_bind 547..555: matinspector prediction name PADS_C score 1.000 sequence tgtggtctc
ctatagggcacgcktggtcgacggcccgggctggtctggtctgtkgtggagtcgggttgaaggacagcatttgtkacatctggtctactgcaccttccctctgccgtgcacttggcctttkawaagctcagcaccggtgcccatcacagggccggcagcacacacatcccattactcagaaggaactgacggactcacgtgctgctccgtccccatgagctcagtggacctgtctatgtagagcagtcagacagtgcctgggatagagtgagagttcagccagtaaatccaagtgattgtcattcctgtctgcattagtaactcccaacctagatgtgaaaacttagttctttctcataggttgctctgcccatggtcccactgcagacccaggcactctccggaagcctggaaatcacccgtgtcttctgcctgctcccgctcacatcccacacttgtgttcagtcactgagttacagattttgcctcctcaatttctcttgtcttagtcccatcctctgttcccctggccagtttgtctagctgtgtggtctc

SEQ ID NO: 24 - DNA, 536 bp, Homo sapiens
  CDS 266..535
  sig_peptide 266..307: Von Heijne matrix score 15 seq LLPLLLLLPMCWA/VE
acttttggggtcacgtgctcattccgtttccctacctcccccaaccttatcccgcccctgggggttcgcgggcatttttcaggaactttctttccggcttgagaagccgccactcccaagatgsagcaggaaccgcggctgctggacaagaggggtgcggtggatactgacctttgctccggcctcgtcgtgaagacacagcgcatctccccgctgtaggcttcctcccacagaacccgtttcgggcctcagagcgtctggtgagatgctgttgccgctgctgctgctgctacccatgtgctgggccgtggaggtcaagaggccccggggcgtctccctcaccaatcatcacttctacgatgagtccaagcctttcacctgcctggacggttcggccaccatcccatttgatcaggtcaacgatgactattgcgactgcaaagatggctctgacgagccaggcacggctgcctgtcctaatggcagcttccactgcaccaacactggctataagcccctgtatatcccctccaacc

SEQ ID NO: 25 - DNA, 274 bp, Homo sapiens
  CDS 35..274
  sig_peptide 35..82: Von Heijne matrix score 14.8000001907349 seq SLPLLLLLLGAWA/IP
acagactacacttgctgaactggctcctggggccatgaggctgtcactgccactgctgctgctgctgctgggagcctgggccatcccagggggcctcggggacagggcgccactcacagccacagccccacaactggatgatgaggagatgtactcagcccacatgcccgctcacctgcgctgtgatgcctgcagagctgtggcttaccaggtgagtccttcaccactgtcacctgccctgctcacaccccttctcaagccagcccccaccggg

SEQ ID NO: 26 - DNA, 230 bp, Homo sapiens
  CDS 29..229
  sig_peptide 29..94: Von Heijne matrix score 13.8000001907349 seq LGLLLLWLRGARC/GV
aaggagtcagtctcagtcaggacacagcatggacatgagggtccccgctcagctcctggggctcctgctactctggctccgaggtgccagatgtggcgtccagatgacccagtttccactgtccctgtctgcatcggtaggagacagagtcaccatcacttgccggacaagccatataattaacatctttttaaattggtatcagcagaaaccaggcaaagccccttggg

SEQ ID NO: 27 - DNA, 195 bp, Homo sapiens
  CDS 44..193
  sig_peptide 44..112: Von Heijne matrix score 13.8000001907349 seq VLLLLLLSGDVQS/SE
agagggcttccggggctgccggtctgagtgcagagctgctgtcatggcggccgctctgtggggcttctttcccgtcctgctgctgctgctgctatcgggggatgtccagagctcggaggtgcccggggctgctgctgagggatcgggagggagtggggtcggcataggagakcgcttcaagattgagggactggg

SEQ ID NO: 28 - DNA, 276 bp, Homo sapiens
  CDS 25..276
  sig_peptide 25..90: Von Heijne matrix score 13.5 seq LGLLLLWLXGARC/DI
agtcagtctcagacaggacacagcatggacatgagggtccccgctcagctcctggggctcctgctactctggctcykaggtgccagatgtgacatccagatgacacagtctccagtcctgcctgcatctgtaggagacagagtcaccatcacttgccgggcaagtcagagcattggcagctatttaaactggtatcagcataaaccagggcatgcccctcgcctcctgatctatgctgcaactactttgtcgaggggcggsccggccagattcagt

SEQ ID NO: 29 - DNA, 240 bp, Homo sapiens
  CDS 25..240
  sig_peptide 25..120: Von Heijne matrix score 13.5 seq LLLLLLLPPPGSC/AG
agggcgctgcgcggcgcagcgaaaatggcggcttccaggtgggcgcgcaaggccgtggtcctgctttgtgcctctgacctgctgctgctgctgctactgctaccaccgcctgggtcctgcgccggccgaaggtcgccydggacgcccgacgagtctaccccacctccccggaagaagaagaaggatattcgcgattacaatgatgcagacatggcgcgtcttctggagcaaggggagggg

SEQ ID NO: 30 - DNA, 461 bp, Homo sapiens
  CDS 80..460
  sig_peptide 80..136: Von Heijne matrix score 13.5 seq WVLLLALLEGVQC/DV
  misc_feature 280..281,311..313: n=a, g, c or t Oligonucleotide
agctctcagagaggtgccttagccctggattccaaggcatttccacttggtgatcagcactgaacacagaggactcaccatggagttggggctgtgctgggttctccttttagctcttttagaaggtgtccaatgtgacgtggaattagtggagtctgggggcggcttggtgcagcctggagggtctctgagactttcctgtgcagcctctggattcaattttagcacttatgagatgcattggatccgccaggctccagggaaggggccggagtgggtnncatatgtcagtggtggaggtggaaccaghnnnaacgcvsactctgtgaagggccgattcaccatctccagagacaatgccaacagttttgtgtatctacaaatggacagtctgcgagtcgaggacaccgctctctattactgtgcgagargggattacgacttctggagtggttattata

SEQ ID NO: 31 - DNA, 112 bp, Homo sapiens
  CDS 28..111
  sig_peptide 28..84: Von Heijne matrix score 13.3999996185303 seq LLLLLSHCTGSLS/QP
aactgtgcatgtcaggctgtgtccaccatggcctggactcctcttcttctcttgctcctctctcactgcacaggttccctctcccagcctgtgctgactcagccacgcgggg

SEQ ID NO: 32 - DNA, 445 bp, Homo sapiens
  CDS 80..445
  sig_peptide 80..136: Von Heijne matrix score 12.8000001907349 seq WVFLVALLRGVQC/QV
  misc_feature 2,7: n=a, g, c or t Oligonucleotide
anctctnggagaggagcccagcactagaagtcggcggtgtttccattcggtgatcagcactgaacacagaggactcaccatggagtttgggctgaattgggttttcctcgttgctcttttaagaggtgtccagtgtcaggttcagttggtggagtctgggggaggcgtggtccagcctgggacgtccctgacactttcctgtgcaggctcgggattcagtttcagtgattatggcatccactgggtccgccaggctccaggcaaggggctggaatgggtggcggttatttcacacgatggaaataacaaatattatggaggctccatgaagggccgagtcaccatctccagagacaactccaggcataccgtgtctttgcaaatgagcagcttgggacctgaggacacggcagtgtattactgtgcgaaagatcgaaccgggggg

SEQ ID NO: 33 - DNA, 321 bp, Homo sapiens
  CDS 41..319
  sig_peptide 41..97: Von Heijne matrix score 12.6000003814697 seq FLLLLAAPRWVLS/QV
aaatactttskgcagagtcctggacctcctgtgcaagaacatgaaacttctgtggttcttccttctcctgctggcagctcccagatgggtcctgtcccaggtgcagctggtgsmgtcgggcccaggactggtgaagccttcggggaccctgtccctaacgtgcactgtsksbggkgrskscataactaattactactggagtbggatccggcagtccccagggaagggactggagtggattgggactatctactacagtgggagcgccgaccacaacccctccctcaggagtmgagccactatttcattagacacgcgcgg

SEQ ID NO: 34 - DNA, 193 bp, Homo sapiens
  CDS 49..192
  sig_peptide 49..108: Von Heijne matrix score 12.5 seq LLXLLTALPPLWS/SS
agagctcagggtgckgagcgtgtgaccagcagtgagcagaggccggccatggccagcctggggctgctgctcctgckcttactgacagcactgccaccgctgtggtcctcctcactgcctgggctggacackgctgaaagtaaagccaccaktgcagacctgatcctgtctgcgctggagagagccaccgggg

SEQ ID NO: 35 - DNA, 438 bp, Homo sapiens
  CDS 151..438
  sig_peptide 151..234: Von Heijne matrix score 12.5 seq LLLLLLLPLRGQA/NT
acgagaaggggagggggcccagccctgctttgggcaatccttgctctgaccactcagacaccgtgtcctcttgcctgggagaggggaagcagatctgaggacatctctgtgccaggccagaaaccgcccacctgcagttccttctccgggatggacgtggggcccagctccctgccccaccttgggctgaagctgctgctgctcctgctgctgctgcccctcaggggccaagccaacacaggctgctacgggatcccagggatgcccggcctgcccggggcaccagggaaggatgggtacgacggactgccggggcccaagggggagccaggaatcccagccattcccgggatccgaggacccaaagggcagaagggagaacccggcttacccggccatcctgggaaaaatggccccatgggaccccctgggatgcca

SEQ ID NO: 36 - DNA, 488 bp, Homo sapiens
  CDS 59..487
  sig_peptide 59..115: Von Heijne matrix score 12.3999996185303 seq ILLLVAAATGTHA/QV
  misc_feature 26..28: n=a, g, c or t Oligonucleotide
atcacacaacagmcacatcsswmvsnnnmcagaagcccccagagtgcagcacctcaccatggactgcacctggaggatcctcctcttggtggcagcagctacaggcacccacgcccaggtccagttggtacagtctgggcctgaggtgaaaaagcctggggcctcagtgaaggtctcctgccaggtttccggatacaacgtcgtggaattatccatccactgggtgcgtcagtcgcctggaaaagggcttgagtggatgggaggttttgaccttgaaagtggtgaaacaatctacgcacagaggttccagggcagaatcaccatgaccgaggactcatcttcagacacagccttcatggagctgatcagcctgagacctgaagatgcggccgtctactactgtgcaacgatccggctgccagtagtgctttttttcgcggcttctggggccagggaaccctggtcgccgtctcctcagcmtccacggg

SEQ ID NO: 37 - DNA, 138 bp, Homo sapiens
  CDS 26..136
  sig_peptide 26..79: Von Heijne matrix score 12.1000003814697 seq VLLLAVLLLAVLC/KV
ttttacccgacccgacgccggcgtgatgtggcttccgctggtgctgctcctggctgtgctgctgctggccgtcctctgcaaagtttacttgggactattctctggcagctccccgaatcctttctccgaagaaagggg

SEQ ID NO: 38 - DNA, 163 bp, Homo sapiens
  CDS 9..161
  sig_peptide 9..83: Von Heijne matrix score 11.8999996185303 seq WLLLLPLLLGLNA/GA
aacttgtcatggagctggcactgcggcgctctcccgtcccgcggtggttgctgctgctgccgctgctgctgggcctgaacgcaggagctgtcattgactggcccacagaggagggcaaggaagtatgggattatgtgacggtccgcaaggatgcctacatggg

SEQ ID NO: 39 - DNA, 427 bp, Homo sapiens
  CDS 35..427
  sig_peptide 35..91: Von Heijne matrix score 11.8999996185303 seq FLFLLTCCPGSNS/QA
  misc_feature 138..139: n=a, g, c or t Oligonucleotide
tctggcaccaggggtcccttccaatatcagcaccatggcctggactcctctctttctgttcctcctcacttgctgcccagggtccaattcccaggctgtggkgactcaggagcccctcactgactgtgtcccccggannacagtcactctcacctgtggctccagtattggagctgtcaccaatggtcattttccctactggttccaacagaagcctggccaagcccccaggacactgatttctgatacgttcaacagacagtcctcgacacctgcccgcttctctggctccctcctggggggcaaagctgtcctgactctttcggatgcgcaacctgacgatgaggctgaatattattgtgtcctctcctatagtggtggtcggccggtgttcggcggagggaccaagctgaccgtcctaagtcag

SEQ ID NO: 40 - DNA, 97 bp, Homo sapiens
  CDS 22..96
  sig_peptide 22..84: Von Heijne matrix score 11.8999996185303 seq LALCLLLGPLAGA/KP
agatcaggaagcaccgggaagatgcaggcctgcatggtgccggggctggccctctgcctcctactggggcctcttgcaggggccaagcctgtgcagg

SEQ ID NO: 41 - DNA, 251 bp, Homo sapiens
  CDS 13..249
  sig_peptide 13..81: Von Heijne matrix score 11.8000001907349 seq CLFVCLFLSQSFA/FV
aaaagtattgggatgcctagttacaargtgtgtggggttttttgtttgtttgtttgtttgtttttgagccagagttttgcttttgtcctccaggctggagtgcagtggcgcgatctctgctcactgcaacctcagcttcccaggttcgggccatcctcctgcctcagcctcccaagtggctgggactgcaggcgcccaccaccacgcctggctaattcttgtgttttcggtggagacggggtttcaccggg

SEQ ID NO: 42 - DNA, 319 bp, Homo sapiens
  CDS 143..319
  sig_peptide 143..205: Von Heijne matrix score 11.6000003814697 seq LLLCLALSGAAET/KP
  misc_feature 139: n=a, g, c or t Oligonucleotide
agcagagggaacagggaagaaacctaaaggctgcaggctgccaggtgtgcttggagagcccccttcttccgccgggcctcgcaagcagcgtaggactgtggagaagggcggtgggcaaggagggaactcgagagcarcnyccatgggcacacaggagggctggwgcctgctgctctgcctggctctatctggagcagcagaaaccaagccccacccagcagaggggcagtggcgggcagtggdcgtggtcctagacygtttcctggtgaaggacsvtgcgcaccgtggagctctcgccagcagtgaggacagggcaagg

SEQ ID NO: 43 - DNA, 412 bp, Homo sapiens
  CDS 35..412
  sig_peptide 35..82: Von Heijne matrix score 11.1999998092651 seq LVVFLLLWGVTWG/PV
  misc_feature 148: n=a, g, c or t Oligonucleotide
agacactcactgcaccggagtgagcgcgaccatcatgtccatgctcgtggtctttctcttgctgtggggtgtcacctggggcccagtgacagaagcagccatattttatgagacgcagsccagcctgtgggcagagtccgaacactgnctgaaaacccttggccaatgtgacgctgacgtgccaggcccgcctggagactccagacttccagctgttcaagaatggggggcccaggagcctgtgcaccttgactcacctgccatcaagcaccagttcctgctgacgggtgacacccagggccgctaccgctgccgctcgggcttgtccacaggatggmcccagctgagcaagctcctggagctgacagggccaaaagtccttgcctgctccctggctctcgatggcgccagt

SEQ ID NO: 44 - DNA, 331 bp, Homo sapiens
  CDS 32..331
  sig_peptide 32..88: Von Heijne matrix score 11.1999998092651 seq IGFLLLWVPASRG/EI
atgagcaaaactgacaagtcaaggcaggaagatgttgccatcacaactcattgggtttctgctgctctgggttccagcctccaggggtgaaattgtgctgactcagtctccagactttctgtctgtgactccaaaggagaaagtcaccatcacctgccgggccagtsagagcattggtagtagtttatactggtaccagcagaaaccacatcagtctccaaagctcgtcatcaagtatgcttcccagtccttctcaggggtctcctcgaggttcagtggcagtggatctgggacagatttcaccctcacaatcaatagcctggaacctggg

SEQ ID NO: 45 - DNA, 520 bp, Homo sapiens
  CDS 176..520
  sig_peptide 176..235: Von Heijne matrix score 11.1999998092651 seq AFLLLVALSYTLA/RD
gaagataatcacttggggaaaggaaggttcgtttctgagttagcaacaagtaaatgcagcactagtgggtgggattgaggtatgccctggtgcataaatagagactcagctgtgctggcacactcagaagcttggaccgcatcctagccgccgactcacacaaggcagagttgccatggagaaaattccagtgtcagcattcttgctccttgtggccctctcctacactctggccagagataccacagtcaaacctggagccaaaaaggacacaaaggactctcgacccaaactgccccagaccctctccagaggttggggtgaccaactcatctggactcagacatatgaagaagctctatataaatccaagacaagcaacaaacccttgatgattattcatcacttggatgagtgcccacacagtcaagctttaaagaaagtgtttgctgaaaataaagaaatccagaaattggcagagcagtttgtcctcctcaatctggtttatgaaacaactgac

SEQ ID NO: 46 - DNA, 383 bp, Homo sapiens
  CDS 25..381
  sig_peptide 25..84: Von Heijne matrix score 11.1000003814697 seq LLALLFFLGQAAG/DL
agcggctccagctaagaggacaagatgaggcccggcctctcatttctcctagcccttctgttcttccttggccaagctgcaggggatttgggggatgtgggacctccaattcccagccccggcttcagctctttcccaggtgttgactccagctccagcttcagctccagctccaggtcgggctccagctccagccgcagcttaggcagcggaggttctgtgtcccagttgttttccaatttcaccggctccgtggatgaccgtgggacctgccagtgctctgtttccctgccagacaccacctttcccgtggacagagtggaacgcttggaattcacagctcatgttctttctcagaagtttgagaaagaactttctaaagc

SEQ ID NO: 47 - DNA, 459 bp, Homo sapiens
  CDS 17..457
  sig_peptide 17..94: Von Heijne matrix score 11.1000003814697 seq FLLLVAAPRWVRS/QV
  misc_feature 399: n=a, g, c or t Oligonucleotide
atactttctgagactcatggacctcctgcacaagaacatgaaacacctgtggttcttcctcctcctggtggcagctcccagatgggtccggtctcargtgcagctgcakgagtcgggcccaggactggtgaagccttcggggaccctgtccctcatctgcggtgtctctggtgattccgtcaccattagtggttggtggagttgggtccgccagcccccagggaagggactggagtggatttcggaaatcgatcatggtggaaacaccaattacaacccgtccctcaagagtcgagtckccatttctttagacaagtccaagaataagttctccctgaggctgacctctgtgaccgccgcggacaccgccatgtatkactgtgcgagaggcggtgcgbncagctcgtccgcttttgatgtctggggcctarggacaatggtcatcatctcttcagcctc

SEQ ID NO: 48 - DNA, 437 bp, Homo sapiens
  CDS 20..436
  sig_peptide 20..76: Von Heijne matrix score 11 seq TLLLLTVPSWVLS/QV
gtgaatcctgctctccaccatggacatactttgttccacgctcctgctmctgackgtcccgtcctgggtcttatcccargtcaccttgarggaatctggtcctgcgctggtgaaagccacacagaccctcagactgacctgcaccttctctgggttctcactcagcactaatagaatgcgtgtgagttggatccgtcagcccccagggaaggccctggagtggcttgcacggattgattgggatgattataagaggtacagcacatctctgaagaccagggtcaccatctccaaggacacgtccaaaaaccaggtgatcctgacaatgaccaacgtggaccctgcggacacagccacctattactgtgcacgcctttcaacggcagctaccccacagttttttgacttctggggccagggagtcctggtctccgtct

SEQ ID NO: 49 - DNA, 456 bp, Homo sapiens
  CDS 40..456
  sig_peptide 40..96: Von Heijne matrix score 10.8999996185303 seq FLLLVAAPRWVLS/QV
aaatactttctgagagtcctggacctcctgtgcaagaacatgadwcatctgtggttcttccttctcctggtggcagctcccagatgggtcctgtcccaggtgcagctgcaggagtcgggcccaggactggtgaagccttcgkwgaccctgtccctcacctgcactgtctctggtgactccatcagtagttactactggagctggatccggcagcccccagggaagggactggagtggattggctatatctattacagtgggagcaccaactacaacccctccctcaagagtcgagtcaccatatcagtggacacgtccaagaaccaattctccctgaagctgagctctgtgaccgcagcggacacggccgtgtattactgtgcgagasggctgcmatactatgataggagtggttatttcagatattttgactactggggccagggaacctggtca

SEQ ID NO: 50 - DNA, 447 bp, Homo sapiens
  CDS 38..445
  sig_peptide 38..94: Von Heijne matrix score 10.8999996185303 seq FLLLVAAPRWVLS/QV
  misc_feature 16: n=a, g, c or t Oligonucleotide
atactttctgagagtnctggacctcctgtgcaagaacatgaaacatctgtggttcttcctcctcctggtggcagctcccagatgggtcctgtcccaggtgcagctgcaggagtcgggcccaggactggtgaagccttcacagaccctgtccctcacctgcacagtctctggtggctccatcgacagtggtaattactactggagctggatccggcagcccgccgggaagggactggagtggattgggcgcatctatagtactgggagcaccaattacaacccctccctcagcagtcgagtccagatatcgttagacacgtccaagaacctgctctccttgaacctgacctctgtgaccgccgcagacacggccgtctatttttgtgcgcgaaccttccccttctactggtacctcgatctctggggccgtggcatcctggtcactgt

SEQ ID NO: 51 - DNA, 466 bp, Homo sapiens
  CDS 38..466
  sig_peptide 38..94: Von Heijne matrix score 10.8999996185303 seq FLLLVAAPRWVLS/QV
  misc_feature 423: n=a, g, c or t Oligonucleotide
atactttctgagagtcctggacctcctgtgcaagaacatgaaacacctgtggttcttcctcctgctggtggcagctcccagatgggtcctgtcccaggtgcagctgcaggagtcgggcccaagactggtgaagccttcacagaccctgtccctcacctgcactgtctctggtggctccatcagcagtggtggttacttctggagttggatccgccagcacccagggcggggcctggagtggattggctacatctattacaattggagcacctactacaatccgtccctcaggagtcgagttaccatgtcaatggacacgtctaagaaccagttctccctgaacctgaactctgtaactgccgcggacacggscatgtattactgtgcsagaggtcgcggacgccttggctggttcashmcttnggggmcagggracccaggtcaccgtctcatcagccgtccaggg

SEQ ID NO: 52 - DNA, 392 bp, Homo sapiens
  CDS 59..391
  sig_peptide 59..115: Von Heijne matrix score 10.8999996185303 seq FLLLVAAPRWVLS/QV
  misc_feature 342: n=a, g, c or t Oligonucleotide
agggtcctgctcacatgggaaatactttctgagagtcctggacctcctgtgcaagaacatgaaacacctgtggttcttcctcctgctggtggcagctcccagatgggtcctgtcccaggtgcagctgcaggagtcgggcccaggactggtgaagccttcagagaccctgtccctcacctgcactgtctctggtggctccatcaggactggttcttactactggacttgggttcgccagccccccgggaagggcctggagtggattggctacatttattatactggggacacctactacaacccgtccctcaagagtcgaattaccatgtcrctagacacgtnywagaaccagttckccctgagcctgacctctgtgactgtcgcagacacgg

SEQ ID NO: 53 - DNA, 172 bp, Homo sapiens
  CDS 14..172
  sig_peptide 14..58: Von Heijne matrix score 10.8999996185303 seq LSVCLLLVTLALC/CY
aaaacaagccaccatgaagctgtcggtgtgtctcctgctggtcacgctggccctctgctgctaccaggccaatgccgagttctgcccagctcttgtttctgagctgttagacttcttcttcattagtgaacctctgttcaagttaagtcttgccaaatttgatgcccctcga

SEQ ID NO: 54 - DNA, 259 bp, Homo sapiens
  CDS 190..258
  sig_peptide 190..237: Von Heijne matrix score 10.8999996185303 seq VLLVLSLSQCLLS/DP
tacctggaaagaacagaaatttgttaatttacaggtctgaaggtgagaaatctgaaattagtcttacaaaactaaaatgaagttgttggaagccttggctccttctggaggttccaggggaaaaaagtatgtttccttgactttccagcckstacaggcccacagcattcctgcttgcagccctatgtcatgtcacctgtcctcttggtgctgtcattgtcacaatgccttctttctgaccctgtcattcctggcctcc

SEQ ID NO: 55 - DNA, 320 bp, Homo sapiens
  CDS 40..318
  sig_peptide 40..96: Von Heijne matrix score 10.8999996185303 seq FLLLVAAPRWVLS/QV
aaacacsyyctgagagtcctggacctcctgtgcaggaccatgaaacatctgtggttcttccttctcctggtggcagctcccagatgggtcctgtcccaggtgcggctgcaggagtcgggcccacggctggtgaagccttcggagamcctgtccctcacctgtagtgtctctggtgtctccgtcactaatttcttctggaactggatccggaagcccccaggcaagggcctggagtggcttggctacatgtcttatggcgtgagcacaaactatcaccccgcctaccagagtcgggtcagtatatcgattgacacgtgggg

SEQ ID NO: 56 - DNA, 457 bp, Homo sapiens
  CDS 39..455
  sig_peptide 39..95: Von Heijne matrix score 10.8999996185303 seq FLLLVAAPRWVLS/QV
aatactttctgagagtcctggacctcctgtgcaagaacatgaaacatctgtggttcttccttctcctggtggcagctcccagatgggtcctgtcccaggtgcagctgcaggaggcgggcccacgactggtgaagccttcggaggccctgtccctcacctgcactgtctctggtgtctccagcagcaattacgactggagttggattcggcaggccccagggaagggactggaatggattgggtatatagacgatagtaagaatagagggagtacgacctacaacccctccctcaagagtcgagtcaccatatcgstggacacgtccaagastcagttgtccctgaggctgacctctgtgacckcsgcagacacggccgtctattattgtgcgagaaagtcatctatgcatagtagtggctggcataaccggagtctctactggtacttcgatcctgg

SEQ ID NO: 57 - DNA, 420 bp, Homo sapiens
  CDS 17..418
  sig_peptide 17..94: Von Heijne matrix score 10.8999996185303 seq FLLLVAAPRWVLS/QV
atactttctgagactcatggacctcctgcacaagaacatgaaagacctgtggttcttcctcctcctggtggcagctcccagatgggtcctgtctcaggtgctgcaggagtcgggcccaggactggtgaagccttcggggaccctgtccctcacctgcgctgtctctggtggctccatcataagtagtaattggtggagttgggtccgccagaccccagggaaggggctggagtggattggggaaatctatgaagatgggatcaccaactacaacccgtccctcaagagtcgagtcatcatttcagtggacaaggccaagaaccagttctccctgaagatgaggtctgtgaccgcctcggacacggccgtctattactgtgcgagaggtagcagctcggttcggacagactactggggcca

SEQ ID NO: 58 - DNA, 469 bp, Homo sapiens
  CDS 38..469
  sig_peptide 38..94: Von Heijne matrix score 10.8999996185303 seq FLLLVAAPRWVLS/QV
atactttctgagagtcctggacctcctgtgcaagaacatgaaacacctgtggttcttcctcctgctggtggcagctcccagatgggtcctgtcccaggtgcagctgcaggagtccggttcaggaccggtggatscttsacagaccctgtscctcacctgcactgkstctggtgtctccatcagcagtagtgataattgttggagctggatccggcagccaccagggaagggcctggagtggattggatacatctatcayagtggggggacctactacaacccgaccctcaagagccgagtcaccatctcggbagacaggatcaggaaccaattctccctgaagctgagctctgtgacggccgyggacacggccgtgtatkactgtggcagagcacagggtagaatggggatcgggacgacgatttttgatctctggggcgggggacaatggtcaccgtctctgcagcct

SEQ ID NO: 59 - DNA, 471 bp, Homo sapiens
  CDS 52..471
  sig_peptide 52..108: Von Heijne matrix score 10.8000001907349 seq ILFLVAAATGAHS/QV
  misc_feature 210: n=a, g, c or t Oligonucleotide
acccaacaaccacatccctcctcagmagcccccagagcacaackcctyaccatggactggacctggaggatcctctttttggtggcagcagccacaggtgcccactcccaggtccagcttgtgcagtctggggctgaggtgaagaagcctggggcctcagtgaaggtttcctgcaaggcttctggatacaycttcactarytmtgctatncattgggtgcgccaggcccccggacaragrcttgagtggatgggrtggatcaacgctgccamtggtwamacaawatattcacagaasttccaggrcagagtcaccwttaccagggacacatccgcgagcacagtctccatggagctgagcagcctgagatctgaagacacggctgtgtatttctgtgcgagagattgggaaattgcagtagtaccaactgctataaactcttacgggttcgaccctggggccagggaacct

SEQ ID NO: 60 - DNA, 348 bp, Homo sapiens
  CDS 193..348
  sig_peptide 193..270: Von Heijne matrix score 10.8000001907349 seq VLFLCVFLGMSWA/GA
agagcaaagaggcaatctgaagagaaaagcataggaaaggaaacagtggtaataggaattggggtaaaatgaggatccttccccacaaacattgctattattcagctcatttcaaaggattccgstgcwgccatttgtgagagccgctggaggctgagtgaaagtcattttgaaagactgatccaaagaagaatggaggccagagtggagcgtgctgtgcagaaaaggcaagtcttatttctttgtgtatttctgggaatgtcttgggctggcgccgaaccgcttcggtattttgtggcggaggaaaccgagagaggcacctdkcttaccaacttggcaaaagaccta

SEQ ID NO: 61 - DNA, 457 bp, Homo sapiens
  CDS 55..456
  sig_peptide 55..111: Von Heijne matrix score 10.8000001907349 seq ILFLVAAATGAHS/QV
acccaaaaaccacacccctccttgggagaatcccctagatcacagctcctcaccatggactggacctggagcatccttttcttggtggcagcagcgacaggtgcccactcccaggttcagctggtgcagtctggaggtgaggtgaagaagcctggggcctccgtcaaggtctcctgcaaggcttctggttacacctttaccagatatgatatcaactgggtgcgacaggcccctggacaagggcttgagtggatgggatggatcagcgctdccaatggtaacacaaattatgcacagdaagtccagggcagagtcaccatgaccacagacacatccacgagaacagcctacatggaactgaggagcctgcgatctgacgacacggccatttattactgtgcgcgagagatmbtagtggbastatgtgatggacagttggggccagggaacctggtca

SEQ ID NO: 62 - DNA, 439 bp, Homo sapiens
  CDS 18..437
  sig_peptide 18..95: Von Heijne matrix score 10.8000001907349 seq FLLLVAAPRWVLS/QE
agtgcttyctgasagtcatggacgtcctgcacaaacacatgaaacacctgtggttcttcctcctcctggtggcagctcccagatgggtcctgtcccaggagcagttacggcagtggggcgcasgactgttgaagccttcggagaccctgtccctcacctgtagtgtctatggtgggtccttcaatggttactactggagctggatccgccagtccccagggaaggggctggagtggattgggggaatcaatcacagcggaagcaccctctccaacccgtccctcaagagtcgcgtcgacctctcagttgatgcgtccaaggaccaggtgtccctgaggctgaaacttgtgaccgccgcggacacggctgtgtacttctgcgcgagaccccattacgatatgtcgactgattcttcgtttgacggttttgatctctgggg

SEQ ID NO: 63 - DNA, 214 bp, Homo sapiens
  CDS 82..213
  sig_peptide 82..126: Von Heijne matrix score 10.6999998092651 seq LLALFFLLRIALA/SQ
accattggtgtgtctgtttttatgccagtactgtgatgttttggttatatagctttgtaatatattttgaagccagatagtatgatgcttctagctttgttctttttgcttaggattgctttggctagtcaaggtcttttgtggttccatacaaattttaaggtttttgttgtttcyatttgtgtgaagactatcattgggatttcggggggca

SEQ ID NO: 64 - DNA, 297 bp, Homo sapiens
  CDS 63..296
  sig_peptide 63..119: Von Heijne matrix score 10.6999998092651 seq ILFLVAAATGALS/QV
gtgcatcacccagcaaccacatctgtcctctagagaatcccctgagadhtccgttcctcaccatggactggacctggaggatcctcttcttggtggcagcrgccacaggagccctctcccaggtgcagctggtrcagtctggaggtgargtgaagaagcctggggcctcagtgagggtctcctgcaaggcctctggatacagcttcatcggctattatgtacactggatacgacagactcctgggcgasgccttgagtggatggggtgggtcaaccctcrsactggcgacaacgggg

SEQ ID NO: 65 - DNA, 370 bp, Homo sapiens
  CDS 237..368
  sig_peptide 237..347: Von Heijne matrix score 10.6000003814697 seq YLLLVLSLSLSLC/CS
aaaggtacacaattgaaaaaaattgtatccttcacaacagatgtgggcagtcaacttttagaccttgtgtctttagtttgacctgtccttcagtgagtgtatataaaattctaagctaaaacatattttctgaaattgtgaaggtattgcatgtctatcttcttgcctactctaaatatatcaatcgttttcttgggaagttagtctttctttcacacttgtctgtagatctttacatgttctttcagttttggaagtcctctgcatatttaatatttgttagtatttgtaaaggttttcttcctgtctacctccttcttgttctctctctctctctctctctctgttgctctctcttgctctctctcca

SEQ ID NO: 66 - DNA, 428 bp, Homo sapiens
  CDS 45..428
  sig_peptide 45..101: Von Heijne matrix score 10.6000003814697 seq ILFLVAAATGVHS/QV
  misc_feature 342..343: n=a, g, c or t Oligonucleotide
aaccacmyccctcctcagaagcccccagagcacaacgcctcaccatggactggacctggaggatcctctttttggtggcagcagccacaggtgtccactcccaggtccaccttgttcagtctggggctgargtgaagaagcctgggactccggtgaacatttcctgtaaggcttttggctacaccttccctgcctttgctatacattgggttcgccaggcccccggacaaagtcttgagtggatgggatgggtcaacattggccatggcaacacaaagtattcacagaagtttcagggcagactcgccatctccagagacacgtccgcgaacatagtctacnnggaactgagcggcctgagatctgaagacacggctgtctattactgtgcgagggataatcttttctttggcagtatgggctttgac

SEQ ID NO: 67 - DNA, 493 bp, Homo sapiens
  CDS 38..493
  sig_peptide 38..85: Von Heijne matrix score 10.6000003814697 seq TVLLLGLLSHCTG/SV
ctgggcctaaggaagcagcactggtggtgcctcagccatggcctggaccgttctcctcctcggcctcctctctcactgcacaggctctgtgacctcctatgtgctgactcagcctccctcggtgtcagtggccccaggaaagacggccagcattacctgtgggggagacaacattgaaagtcaagttgtacactggcaccagcagaagccagggcaggcccctatattggtcatctatgatgataccgaccggccctcagggatccctgaccgattctctggctccaactctgggcacacggccaccctgaccatcagcagggtcgaagccggggatgaggccgactattattgtcaggtgtgggatagaagtagtggtcagggaatattcggcggagggaccaagctgaccgtcctacgtcagcccaaggctgccccctcggtcactctgttcccgccctcctctgaggagcttcaagccaacaaggccaca

SEQ ID NO: 68 - DNA, 180 bp, Homo sapiens
  CDS 36..179
  sig_peptide 36..80: Von Heijne matrix score 10.6000003814697 seq LLFLLLFVCFSRQ/GL
tggcagttactccagctcccaaatatagatattccatgaggttgttgtttttgttgttgtttgtttgtttttcgagacagggtctcgctttgtctctcaggctggaatgcagtggtatgatcatggcttactgcagcatcagcctcccaggctcaagcagtcctctcacctcagcctcca

SEQ ID NO: 69 - DNA, 259 bp, Homo sapiens
  CDS 38..259
  sig_peptide 38..94: Von Heijne matrix score 10.6000003814697 seq FLLLVSAPRWVLS/QV
atacttyctgagagtcctggacctcctgcacaagaacatgaaacacctgtggttcttcctcctcctggtgtcagctcccagatgggtcctgtctcaggtgcagctacaggagtcgggcccaggactggtgaagccttcggggaggctgtccctcgcctgcgatgtggtggaattgagtccgccggcccccaggggcgggtctgcagtgcatctcagaaatctttcatcatgggagccccacctacaacccgtctcgggg

SEQ ID NO: 70 - DNA, 178 bp, Homo sapiens
  CDS 7..177
  sig_peptide 7..102: Von Heijne matrix score 10.6000003814697 seq VVFLLLLVSTLSS/VV
cgtataatgacttactttcctctgggtagatacccagtaatgggattgctggatcaaatggtagttgtgtttttacttcttttagtctccacactttcttccgtagtggttttactagtttgcattcccaccagcagtgtaaaattgttcccttttcaccatatccacaccaactggg

SEQ ID NO: 71 - DNA, 131 bp, Homo sapiens
  CDS 40..129
  sig_peptide 40..96: Von Heijne matrix score 10.5 seq WVLLVAMLRGLQC/QV
agctctgggagacgagcccagctctgcagtggactcaccatggagtttgggctgagctgggttctcctcgttgctatgttaagaggtctccagtgtcaagtgcagctggtggagtctgggggaaccgcggg

SEQ ID NO: 72 - DNA, 217 bp, Homo sapiens
  CDS 47..217
  sig_peptide 47..91: Von Heijne matrix score 10.5 seq LSLLILLLENVSG/FP
ttgcttacaattttaatgtgtctcattgctactggtcctccttctaatgtatctgagcttgttaattctacttttggaaaatgtcagtggctttccctttcctctaattttccagcttcatgcatcccctggccataagatacttccagactgtatgatatattctatcactgtcagccttatgttccctgtggttgactatataagcacgcaaggg

SEQ ID NO: 73 - DNA, 192 bp, Homo sapiens
  CDS 100..192
  sig_peptide 100..183: Von Heijne matrix score 10.5 seq SLWFXCLLFLLFA/WP
agttaaaatcatgtactgtgatcagtcacctggtttttgatttttatgaaggttttttttgtttagatagttgttaaatttggtgttcctgtggggaggatgatgagagccttctatttggctatcttgttctgcctctctctctccttatggttctdktgtttactttttttgctttttgcttggcctggg

SEQ ID NO: 74 - DNA, 329 bp, Homo sapiens
  CDS 23..328
  sig_peptide 23..82: Von Heijne matrix score 10.3999996185303 seq FLTLLLHCTGSLA/QL
agagctctggggagtctgcaccatggcttggaccccactcctcttcctcaccctcctcctccactgcacagggtctctcgcccagcttgtgctgactcaatcgccctctgcctctgcctccctgggagcctcggtcaagctcacctgcactctgagcagtgggcacagcaactacggcatcgcttggtatcagcagcagccagagaagggccctcgattcttgatgaaagttaacagtgatggcagccacatgaaggcggacgggatccctgatcgcttctcaggctccagctctggggctgagcgctacctctccatctccagcctca

SEQ ID NO: 75 - DNA, 314 bp, Homo sapiens
  CDS 259..312
  sig_peptide 259..300: Von Heijne matrix score 10.3999996185303 seq PLALFFLLSVALA/IQ
tagggtgagagatggggatctagttttattcttctgcatatggatatccagttttcccagtaacatttattgaagagactggcctttccccaatgagtgttcttggcacctttgtcaaaagtcagttggccgtagatatgtggattaatttctgtgttccctgttttgttccattggcctatgtgtctgtttttatgacagtaccaggttgttttggttactacagctttgtagtttactttgaggtctgttagtgtgatgcctctagctttgttctttttgctcagtgttgctttggctattcagggtcaggg

SEQ ID NO: 76 - DNA, 447 bp, Homo sapiens
  CDS 59..445
  sig_peptide 59..115: Von Heijne matrix score 10.3999996185303 seq XFCLLAVAPGAHS/QV
atcatccaacaaccacatcccttctctacagaagcctctgagaggaaagttcttcaccatggactggacctggaggrwcttctgcttgctggctgtagctccaggtgctcactcccaggtgcagctggtgcagtctggggctgaggtgaagaagcctggggcctcagtgaaggtttcctgcaaggcatctggatacaccttcaccagccactatatgcactgggtgcgacaggcccctggacaagggcttgagtggatgggaataatctaccctgatagtgataccactaagtaccbacagaacttccagggcagagtcaccatgactagggacacgtccacgagcacagtctacatggagctgagcagcctgacatctgacgacacggccgtgtattattgtgctagagaggcgtatagtgggagctaccgctttgactactgggg

SEQ ID NO: 77 - DNA, 388 bp, Homo sapiens
  CDS 16..387
  sig_peptide 16..93: Von Heijne matrix score 10.3000001907349 seq LLLLVAAPRWVLS/QL
agctttctgagagtcatggatctcatgtgcaagaaaatgagacacctgtggttcctcctcctgctggtggcggctcccagatgggtcctgtcccagctgcagcttcaggagtcgggcccaggactggtgaaggcttcggagaccctgtccctcgcctgcagtgtctctggtgactccatcagcagtggtaattattactggggctggatccggcagcccccagggaagggactgcagtggcttgggagtctttggaatcgtggcggtccgcaatacaayhcctccctcaagaatcgagtcaccgtgtccgtagacacgtccacgaatcatttctttctgagactgaattccgtgaayvghggacacggcaatttattactgtgcgcga

SEQ ID NO: 78 - DNA, 121 bp, Homo sapiens
  CDS 25..120
  sig_peptide 25..72: Von Heijne matrix score 10.1999998092651 seq XLXLSVLLGXXXX/KX
ctgaccttccctcccggcagcagcatgcgggrgtkgctgkysttgagtgtcctgttrgggsckrtstbtkgcaaggmggactttgtggggcatcaggtgctccgaatctctgtagccgatg

SEQ ID NO: 79 - DNA, 149 bp, Homo sapiens
  CDS 36..149
  sig_peptide 36..143: Von Heijne matrix score 10.1999998092651 seq FLLFFCFVFCLRG/QG
tccgagcagccagctctgtgtaagcacatccaggaatggcagaatccagggaggaaggtgaaagctgtgttgagagccactgtgtgctctttttcaccctgttttttttgttgtttttttgttttgttttttgtttgaggggacagggg

SEQ ID NO: 80 - DNA, 410 bp, Homo sapiens
  CDS 80..409
  sig_peptide 80..136: Von Heijne matrix score 10.1000003814697 seq WLFLVAFLKGVQC/EV
agctctgagagaggagcccagccctgggattttcaggtgttttcatgtggtgatcaggactgaacagagagaactcaccatggagcttgggctgagctggctttttcttgtggcttttttaaaaggtgtccagtgtgaggtgcagttgttggagtctgggggaggcttggtccagcctggggggtccctgagactctcatgtgcagcctccggattcacctttagctcctatgccatgctctgggtccgccaggctccaggtaaggggctggagtgggtctcaggtattagtgctggtgctgatgatacatatgatgcagactccgtgaagggccggttcaccatttccagagacgattccaagaaaatcctatatctacaaatgaacagcctgagagccgaggacaggc

SEQ ID NO: 81 - DNA, 219 bp, Homo sapiens
  CDS 38..217
  sig_peptide 38..106: Von Heijne matrix score 10.1000003814697 seq VLGLLVLFLTCYA/DD
gaacaatttatctgcacgaataccccgtgctaccagaatggctgtctcagtacttcgcctgacagttgtcctgggactgcttgtcttattcctgacctgctatgcagacgacaaaccagacaagccagacgacaagccagacgactcgggcaaagacccaaagccagacttccccaaattcctaagcctcctgggcacagagatcattgagaatgcggg

SEQ ID NO: 82 - DNA, 399 bp, Homo sapiens
  CDS 81..398
  sig_peptide 81..152: Von Heijne matrix score 10 seq LLLLQALPSPLSA/RA
gaagaagagggtagaggaggagagggaggaggaggagggaggtggcggcgccgtggcggaggagcaggagcaggagggggatggagaggagaaggctcctgggtggcatggcgctcctgctcctccaggcgctgcccagccccttgtcagccagggctgaacccccgcaggataaggaagcctgtgtgggtaccaacaatcaaagctacatctgtgacacaggacactgctgtggacagtctcagtgctgyaactactactatgaactctggtggttctggctggtgtggaccatcatcatcatcctgagctgctgctgtgtttgccaccaccgccgagccaagcaccgccttcaggcccagcagcggcaacatgaaatcaacctgatcgcttaccgag

SEQ ID NO: 83 - DNA, 398 bp, Homo sapiens
  CDS 288..398
  sig_peptide 288..368: Von Heijne matrix score 9.89999961853027 seq LCLLLFSLSLFLC/HE
cactctacctctgacagcatgtatattgcaccagtagctaacaaaaactggtctagtcaaaccaaatgggcacaaaagaaccaggataccaaaagttaagctcatacagctgcaaaccatatcacttcttggtaacaatgcaagacctcataaacctaaagaagagaaagaaaagaaaacttttgttactttvcttttttgcttgtcacttatatacaggctatgtgagaatataatttgtaggtataacacattaagaaaaagttatcttcattggatagaattgaatggtggtcgctgataggaatagggcgtcctctagctcttatctctgtctcttactcttttctctttctctttttctctgtcatgagactgtgtgtgacagggccacctgt

SEQ ID NO: 84 - DNA, 488 bp, Homo sapiens
  CDS 62..487
  sig_peptide 62..118: Von Heijne matrix score 9.89999961853027 seq FLFVVAAATGVQS/QV
  misc_feature 210,293: n=a, g, c or t Oligonucleotide
agcatcacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagaagcctgggtcctcggtgaaggtctcctgcaaggcttctggaggcaccttcagcanctatgctatcagctgggtgcgacaggcccctggacaagggcttgagtggatgggagggatcatccctatctttggtacagcanactacgcacagaagttccagggcagagtcacsattaccgcggacgratccacgascacarcctacatggagctgagcagcctgagatctgaggacacggccstgtattactgtgcgagaggtcaagcccccggtagggtagtagtaccacttttcctctggggccagggaacctggtcaccgtctcctcagcctc

SEQ ID NO: 85 - DNA, 290 bp, Homo sapiens
  CDS 30..290
  sig_peptide 30..164: Von Heijne matrix score 9.89999961853027 seq LLSLLSFLDETSG/LS
cttctttttcttcgtaacttcatggcaacatgacctacagttactcatttttcaggcctgagttgatcgttaatcatcttaattatgttcattctgaagccaacaggagaaccaagaccaaaactttattgtctctgctttcatttcttgatgaaacctctggactaagcacacatcttccttgtttatctctctcaaaggagtgtggagtgcttcatctggacatccacgggaagaaggaagacatgagagatgaggtcttgctggccttgaactyctgcacccacagg

SEQ ID NO: 86 - DNA, 336 bp, Homo sapiens
  CDS 100..336
  sig_peptide 100..156: Von Heijne matrix score 9.89999961853027 seq ILFLVFLLAGLRS/KA
ccagatctgttctgcaacattcaccgttctctgcatccagctctgcttatctgctgttaccttggacaccagagcagctataggtatctgccagragcwatgaaatcattcagccggatcctcttcctcgtcttcctcctcgccggcctgaggtccaaggccgctccctcagcccctctgcctttgggctgtggctttccggacatggcccacccctctgagacttcccctctgaagggtgcttctgaaaattccaaacgagatcgccttaacccagaatttcctgggactccttaccctgagccttccaagctacctcatacggtttccctggaa

SEQ ID NO: 87 - DNA, 262 bp, Homo sapiens
  CDS 108..260
  sig_peptide 108..230: Von Heijne matrix score 9.89999961853027 seq SLCHLGWSAVVQS/QP
taggagtggagtgactgggtgatatgataactctatgtttaactttttaaggaactgctagacttttctgaagtgactatgccattttacattaacaccaggagtgtatgagggtgccgatttttccacatcctcaccaactctcgttattattcatccatttatttatttatttatttagagaaagggtctctctctgtcacctaggctggagtgcagtggtacaatcacagccaactacaaccttgacctcccgcgctam

SEQ ID NO: 88 - DNA, 149 bp, Homo sapiens
  CDS 18..149
  sig_peptide 18..128: Von Heijne matrix score 9.89999961853027 seq FLFVLFCFGGSRA/LL
ttcggagcttgaccagcatgtggaaggagagctctcatggctgcaataacttagggagttcctacctggatgacactggggtaggaagttttctgtttgttttgttctgtttcggagggtcccgtgcacttctcttgcctggatctggg

SEQ ID NO: 89 - DNA, 315 bp, Homo sapiens
  CDS 236..313
  sig_peptide 236..283: Von Heijne matrix score 9.69999980926514 seq FLCLLFYLIVSCG/AV
gtaaaagacaaataacttgtatggtttgcaaaatgatctgaatatgtgcttttataacattcagaatacacccaaaagtaaactttaggtttaatgtacagtatgttttctatgtaattgttttgaataagtaatamcatybtacatggcttaaaactgaaaaacgtattcctgttacttcttgatgcttttgagaaatgaataatgttttctcccttttaaatggtagtacagcatgcacacttttctgtgcttgcttttttatctcatagtatcttgtggagctgttttcttaacagtcccttctccccaagg

SEQ ID NO: 90 - DNA, 179 bp, Homo sapiens
  CDS 24..179
  sig_peptide 24..140: Von Heijne matrix score 9.69999980926514 seq SIILXLXFPGILG/QA
  misc_feature 57: n=a, g, c or t Oligonucleotide
agmrctctggggcagtctgcaccatggcctggcaccccactcctcctcctcttcsbncwcctcctccactgmacagggwctcyctcccagcctgtgctgactcaatcatcctctgmctctgmttccctgggatcctcggwcaagctcacctgmactctgagcagtggacacagtaccta

SEQ ID NO: 91 - DNA, 423 bp, Homo sapiens
  CDS 311..421
  sig_peptide 311..373: Von Heijne matrix score 9.69999980926514 seq LHLLILLSGTCFT/WI
gactctatagsrcaaatggttaagaacatatacttgggagtcagttgatctgggttcaaattctagctgtgctactttctacctatgctgtattggacaaatgatactgtgtatctgtttcttcaaccgtaagttgggtatattaatatccttacctcaaaaggtcatgatgattaagtgagtbaatgcatgtaaaatgccttctgtgccgggcagtcagaaaccactcaataaatattgattattctcaccaaagatgtgcttcctgacctcaaaagcctgtcagcctaatataaagacagtgtgacaaatgccaatcctgcctcaggacatcttgcacttgctgatccttctgtctggaacatgcttcacttggattcttttgtggcttccactctcccctctgttgggcctgaaatgcta

SEQ ID NO: 92 - DNA, 316 bp, Homo sapiens
  CDS 62..316
  sig_peptide 62..121: Von Heijne matrix score 9.60000038146973 seq LLALLLCGRPGRG/QT
  misc_feature 264,266: n=a, g, c or t Oligonucleotide
accgcagctccagagccctgcgggaggactcagagtcagggacacagcagcgtccggcgagatgaaggcgctcggggctgtcctgcttgcbctcttgctgtgcgggcggccagggagagggcagacacagcaggaggaagaggaagaggacgaggaccacgggccagatgactacgacgaggaagatgaggatgaggttgaagaggaggagaccaacaggctccctggtggcaggagcagagtgctgctgcggtgctacacctnknagtccctgcccagggacgagcgctgcaacctgacgcagaactgctcacat

SEQ ID NO: 93 - DNA, 508 bp, Homo sapiens
  CDS 245..508
  sig_peptide 245..289: Von Heijne matrix score 9.60000038146973 seq EYVLLLFLALCSA/KP
agtactaacatggactaatctgtgggagcagtttattccagtatcacccagggtgcagccacaccaggactgtgttgaagggtgttttttttcttttaaatgtaatacctcctcatcttttcttcttacacagtgtctgagaacatttacattatagataagtagtacatggtggataacttctacttttaggaggactactctcttctgacagtcctagactggtcttctacactaagacaccatgaaggagtatgtgctcctattattcctggctttgtgctctgccaaacccttctttagcccttcacacatcgcactgaagaatatgatgctgaaggatatggaagacacagatgatgatgatgatgatgatgatgatgatgatgatgatgaggacaactctctttttccaacaagagagccaagaagccatttttttccatttgatctgtttccaatgtgtccatttggatgtcagtgctattcacgagttgtacattgctca

SEQ ID NO: 94 - DNA, 321 bp, Homo sapiens
  CDS 36..320
  sig_peptide 36..92: Von Heijne matrix score 9.60000038146973 seq FLLLVAAPRWAMS/QV
actttctgagaggcctggacctcctgcacaagaacatgaaacacctgtggttcttcctcctcctggtggcagctcccagatgggccatgtctcaggtgcaactgcaggaatcgggcccgagactggtgaaaccttcggggaccctgtccctcacctgcagtgtctctggtggctccatggccactagtgactggtggagttggtttcgacagacmccggagaagggtctggagtggattggggaaatctttcagactgggcccaccaattacaacccgtccctcaagagccgcgtctccatgtcagtggacatgtccaaga

SEQ ID NO: 95 - DNA, 402 bp, Homo sapiens
  CDS 15..401
  sig_peptide 15..92: Von Heijne matrix score 9.5 seq FLLLVAAPRWALS/QL
gctttctgagagtcatggatctcacgtgcaagaaaatgaagcacctgtggttcttcctcctgctggtggcggctcccagatgggccctgtcccaactgcagctgcaggagtcgggcccaggactggtgaagccttcggagaccctgtccctcacgtgcactgtctctggtgaatccatcaccactaattcattctgctgggcctggatccgccagcccccggggaaggggctggaatggcttgggactgtatgttatggtgggaccacctackrcaackcgtccctgaagagtcgagtcaagttatcgttggacacgtccacgaatcagttctccctgaaggtcacctctatgaccgccggagacgcggctgtccattactgtgcggggctgcgtgttagtg

SEQ ID NO: 96 - DNA, 315 bp, Homo sapiens
  CDS 118..315
  sig_peptide 118..306: Von Heijne matrix score 9.5 seq VLLFLILLYMSWS/AS
agagacacacttggacgrttcctgcagraatcagtgaggcagtctcctcccaggggcttggsgcctggctcgaggcgaggctgccggcccggacgctgactgcccagtgccacagacatggccaacgggaccaacgcctctgccccatactacagctatgaatactacctggactatctggacctcattcccgtggacgagaagaagctgaaagcccacaaacattccatcgtgatcgcattctgggtgagcctggctgccttcgtggtgctgctcttcctcatcttgctctacatgtcctggtccgcstccccg

SEQ ID NO: 97 - DNA, 460 bp, Homo sapiens
  CDS 62..460
  sig_peptide 62..118: Von Heijne matrix score 9.39999961853027 seq FLFVVAAATGVQS/QX
agcatcacataacaaccasattcctcctctaaagaagcccctgggagcacagctcatcaccatggactggacctggaggttcctctttgtggtggcagcagctacaggtgtccagtcmcaggkscasctggwgcagtctggggctgaggtgaagaagcctgggtcctcggtgaaagtctcctgcarggcytctggaggcatcytcagcasctatagcttcaactgggtgcgmcaggcccctggacaggggtttgagtggttgggaaggatcatccccatcctcggtataacaaactacgcagagaagtttcggggcagactcacgatcaccgtggacaaatccacgcgtgttgtttacatggagcagagcagtctgacatctgcggacacggccgtatattattgtgcgaaaccgactatgacttcggaactacgggtctactatcagwctacactatgg

SEQ ID NO: 98 - DNA, 230 bp, Homo sapiens
  CDS 140..229
  sig_peptide 140..205: Von Heijne matrix score 9.39999961853027 seq LLLLSAFTSQTVS/GQ
aacagaacaatatcaaatagctaacttcacccccaaccacagtccttgctgttggcatttactcaactagtctttaattcctgttttgacaaactttataaggtgctacaagacagatgatttttcaccatctaccataatgtggaacagatattttgtcttctatctcctgcttttgtcagcgtttacgagtcaaacagtatccggacaaagaaagaaaggaccccggg

SEQ ID NO: 99 - DNA, 467 bp, Homo sapiens
  CDS 40..465
  sig_peptide 40..96: Von Heijne matrix score 9.39999961853027 seq FLLLVAAPRWVLS/QL
aaatactttctgagagccctggacctcctgtgcaagaacatgaaacacctggggttcttcctcctgctggtggcagctcccagatgggtcctgtcccagctgcagctccaggagtccggctcaggactggagaagccttcacagaccctgtccctcacctgctctgtctctggtggctccatcagtagtgatgatttgtcgtggagctggatccgacagccgccagggaagggcctggagtggattggctacatttatcaaaatgagaggaccctctacaacccgtccctcaagagtcgagccgccatttcagtggacaggtccaagaaccagttctccctgaaactgacctctgtgaccgccgcggacatggccgtatattactgtgccaccagtgtcatgawttcctttgggggcgttctcgtccctaatctgtttttgactactggggccagggaatctcgtca

SEQ ID NO: 100 - DNA, 504 bp, Homo sapiens
  CDS 39..503
  sig_peptide 39..95: Von Heijne matrix score 9.30000019073486 seq FLLLVAGPRWVLS/QV
aatactttctgagagtcctggacctcctgtgcaagaacatgaaacacctgtggttcttcctcctgctggtggcaggtcccagatgggtcctgtcccaggtgcagctgsdkgagtcgggcccaagactggtgaagccttcacagaccctgtccctcacctgcactgtatctggggcctccgtcagcagtcgtgggtactattggacctggatccgccagctcccagggaagggcctggagtggattggctacatctgktacactgggagcaccttctacaacccgtccctcaagagtcgattaaccatatcaatagacacgtctaagaatcagttctccctgaacctgaggtctgtgactaccgcggacacggccgtctattactgtgcgagagaccatttcgatcttctattcgacccctggggccagggaaccctggtcaccgtctcctctgcmtccaccaagggcccatcggtcttccccctggcascctcctccaagagca

SEQ ID NO: 101 - DNA, 336 bp, Homo sapiens
  CDS 148..336
  sig_peptide 148..270: Von Heijne matrix score 9.30000019073486 seq VLXLFCFVFEAES/RS
agagctcgcggtggactccgacccggcgcaacatggccgcagcctcgcctctgcgcgactgccaggcctggaaggatgcgaggctcccgctctccaccacaagcaacgaagcctgcaagctgttcgatgccacgctgacccagggtaatggcctgccgagagaggccgcggccccttctgtggaggtctaggggaaggttttttaattggggaaagctgtttttttgttttgttttgmttttgttttgttttgtttttgaggcggagtctcgctctgtcgcccaggctggagtgcagtggcgctatttcggctcactacaagctttgcctccctgg

SEQ ID NO: 102 - DNA, 289 bp, Homo sapiens
  CDS 214..288
  sig_peptide 214..276: Von Heijne matrix score 9.19999980926514 seq FILFHWSLCLCLC/QY
cccttatgttttcttttagtaatttcatagtttcaagttttatatataagtctttaatccattttgagttgatttgtgtatatggtggagacagggtctagtcttggtcttctgcatgtgactttccaattttcccagcaccatttattggagaaactgtctttttcccagtgcatgttcttggcacctttgttgaaaaacagttggccatagatgcatgaatttatttctgggttctttattctctttcattggtctctgtgtttgtgtttatgccaataccatgccg

SEQ ID NO: 103 - DNA, 383 bp, Homo sapiens
  CDS 252..383
  sig_peptide 252..377: Von Heijne matrix score 9.19999980926514 seq LLVCLFAVTSILC/SS
atcctccagctaataagtgtccaagctgggactcaaacttgggccttttaactgtgctgctattctacctctcccttgctctttccagaccaggcttgggacataacactaacacccttttcctttcatttcatctcttgtccttcagtcattcctaaacattgacaybcattgagttccttggctctggccatagtcctttctccctttcccctctggggcatcaaatagtgattacagtatccacagggatggcatatgccatttcaccatttcacagttcctggaatccacttttcacttctcataaagcttcagcaagccattctcatcttgggttgcttgtttgcctatttgctgttacatccattctctgctcctca

SEQ ID NO: 104 - DNA, 211 bp, Homo sapiens
  CDS 30..209
  sig_peptide 30..74: Von Heijne matrix score 9.19999980926514 seq PVLLLALLGFILP/LP
  misc_feature 83: n=a, g, c or t Oligonucleotide
agaaagagattaccagccacagacgggtcatgagcccggtattactgctggccctcctggggttcatcctcccactgccaggnagtgcargcgctgsstckgccagtttgggacagttcagcatgtgtggaaggtgtccgacmtgccccggcaatggacccctaagaacaccagctgcgacasggvttrgggtgccaggacacgttgatgc

SEQ ID NO: 105 - DNA, 492 bp, Homo sapiens
  CDS 29..490
  sig_peptide 29..97: Von Heijne matrix score 9.10000038146973 seq SLLLFSLMCETSA/FY
agtcattacggcgacacgtggatccaagatggcgacggcgatggattggttgccgtggtctttactgcttttctccctgatgtgtgaaacaagcgccttctatgtgcctggggtcgcgcctatcaacttccaccagaacgatcccgtagaaatcaaggctgtgaagctcaccagctctcgaacccagctaccttatgaatactattcactgcccttctgccagcccagcaagataacctacaaggcagagaatctgggagaggtgctgagaggggaccggattgtcaacacccctttccaggttctcatgaacagcgagaagaagtgtgaagttctgtgcagccagtccaacaagccagtgaccctgacagtggagcagagccgactcgtggccgagcggatcacagaagactactacgtccacctcattgctgacaacctgcctgtggccaccggctggagctctactccaaccgagacagcgatgacaag

SEQ ID NO: 106 - DNA, 126 bp, Homo sapiens
  CDS 41..124
  sig_peptide 41..94: Von Heijne matrix score 9.10000038146973 seq LISLLQCAHVSLG/LQ
tccatttgcagcccatggttgtcacatcacgctgtttataatgcccagcccctgcctgatctctcttcttcaatgtgctcatgtgtcccttggcttacagtatccatgcsttctccttctccctcc

SEQ ID NO: 107 - DNA, 242 bp, Homo sapiens
  CDS 82..240
  sig_peptide 82..132: Von Heijne matrix score 9.10000038146973 seq LVLAAFCLGIASA/VP
accagaccgcggacgtctgtaatctcagaggcttgtttgctgagggtgcctgcgcastgcgacggctgctggttttgaaacatgaatctttcgctcgtcctggctgccttttgcttgggaatagcctccgctgttccaaaatttgaccaaaatttggatacaaagtggtaccagtggaaggcaacacacagaagattatatggcgcgaatgaagaaggatggaggagagcagcgtgggaggg

SEQ ID NO: 108 - DNA, 336 bp, Homo sapiens
  CDS 81..335
  sig_peptide 81..137: Von Heijne matrix score 9 seq WVFLVAIFTGVHC/EV
agctctgggagaggagccccagccgtgagattcccagaagtttccacttggtgatcagcactgaacacagaccaccaaccatggagtttggccttaattgggttttccttgttgctatttttacaggtgtccactgtgaggtgcagttggtggagtctgggggagacctggtacagccagggcggtccctgagactctcctgtacagcttctggattcacctttggtgattatgccatgacctggttccgccaggcttcagggaagcgactggagtggctaggtttcattagaaatagaggttcsggtgggtcagcagagtacggcgcgtctgtga

SEQ ID NO: 109 - DNA, 160 bp, Homo sapiens
  CDS 6..158
  sig_peptide 6..56: Von Heijne matrix score 9 seq LLILLMLLLFAIH/IN
cagctatgaaaaactgcctactcatactcctcatgcttctcttatttgcaatacacataaaccgtatgaatgtaaggaatgtgggaaatactttagtcgtagtgcaaatcttattcagcatcagagtattcatactggagagaaaccctttgaatgtggg

SEQ ID NO: 110 - DNA, 527 bp, Homo sapiens
  CDS 81..527
  sig_peptide 81..137: Von Heijne matrix score 9 seq WIFLLAILKGVQC/EV
  misc_feature 307..308,466..467: n=a, g, c or t Oligonucleotide
agctctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggaggcttggtacagcctggcaggtccctgagactctcctgtgcagcctctggattcacctttgatgattacgccatgcactgggtccggcaagctccagggaagggcctggagtgggtctcaggaattacttggaatagtggtannataggctacgcggactctgtgaagggccgattcaccatctccagagacaacgccaagaactccctgtatttgcaaatgaacagtctgagaactgaggacacggccttctatttctgtgcaaaagctcgcgggctctttagcgatacctggccctacvnncactacgctatggacgtctggggccaagggaccacggtcaccgtctcctcagcctccacc

SEQ ID NO: 111 - DNA, 154 bp, Homo sapiens
  CDS 80..154
  sig_peptide 80..121: Von Heijne matrix score 8.89999961853027 seq LLVFFVLWTCSLA/LL
ctggaaagggaggagccaaaaggggaacgctttcttgattgtcccagcctcattaggagctaccacagggctctcctgcatgctccttgttttctttgtgctctggacttgctcacttgcactgcttgcttcttccccaatcgcmgccyaccca

SEQ ID NO: 112 - DNA, 441 bp, Homo sapiens
  CDS 59..439
  sig_peptide 59..115: Von Heijne matrix score 8.89999961853027 seq ILLLVAAATDASS/QM
atcacccatcaaccacatccctcctctagagagtcccctgaaagcacagctcctcaccatggactggacctggagaatcctcctcttggtggcagcagccacagatgcctcctcccagatgcagctgttgcagtctgggcctgaagtgaagaagactgggtcctcagtgaaactttcctgcacggcctccggcgacaccctcgcctaccactacctgcactgggtgcgacaggcccccggacaagcgcttgagtggatgggatggatcacacctttcagtggagacaccaacttcgcacagcgattccaggacagactcaccttcaccagggacaggtctatgagcacagtctacatgaccctgaccagcctgatatctgaagacacagccatgtattactgtgccactgatggacgtcgcaccaaccgtctttttgaaca

SEQ ID NO: 113 - DNA, 369 bp, Homo sapiens
  CDS 164..367
  sig_peptide 164..217: Von Heijne matrix score 8.80000019073486 seq LGCLLWLLTHIKA/QD
  misc_feature 290..292: n=a, g, c or t Oligonucleotide
cagtttcagtttctctcccttcctagtagagacaaaaaggagacacattttatccgtgcatccaaagactccgatgttggtcatggacttgggaagacagtcttcccttggcgtttgatcactgcggagatgccttccttgatcattcacccacattcccttgatggcaggtcaattgctgggatgcctgctttggctgctcacccacattaaagcccaggactcagtcagggatgcctactggaagactggtagctgcccacctccatttctccatgtgtctaccttcnnnkktaaacttaccttctccactaagggcaaccttctgcattccattcctctctcttcccccttagcctgtgttcttag

SEQ ID NO: 114 - DNA, 334 bp, Homo sapiens
  CDS 20..334
  sig_peptide 20..292: Von Heijne matrix score 8.80000019073486 seq LFLMLLGELGVFA/SY
  misc_feature 295: n=a, g, c or t Oligonucleotide
agctctgaattgggaagggatgaaggaggctgtgcctccgggttgcacgaagagtccgagtcatttctcagaaggttttgataggtgggccttagaggagacgccgccggaaaacctgattggcgccctcttggcgatcttcgggcacctcgtggtcagcattgcacttaacctccagaagtactgccacatccgcctggcaggctccaaggatccccgggcctatttcaagaccaagacatggtggctgggcctgttcctgatgcttctgggcgagctgggtgtgttcgcmtcntacgccttcgcgccgctgtcactcatcgtgcccctcagc

SEQ ID NO: 115 - DNA, 153 bp, Homo sapiens
  CDS 21..152
  sig_peptide 21..74: Von Heijne matrix score 8.80000019073486 seq LLSCWALLGTTFG/CG
acacccctgccagcggcaccatggctttcctctggctcctctcctgctgggccctcctgggtaccaccttcggctgcggggtccccgccatccaccctggctgccaactgagcccgcggctccctccgaccctgctccccacagagcgcgggg

SEQ ID NO: 116 - DNA, 292 bp, Homo sapiens
  CDS 47..292
  sig_peptide 47..106: Von Heijne matrix score 8.80000019073486 seq LWLFFVLNLGSFA/FS
taccagtaacttctttcatggttcaataaaatcatagctttagtttatggcaccttttcaaaacttcctttggcttttctttgtgcttaatttaggwagttttgcttttagctcamttccdaattctcttttttacacaattcattttggtcctaatttctttactttactatataaacaaggtgctgaaatgtgtgtgtatgtatttaacttcctctacccatttgctcttggttatttcttcagttatgatattctggatttgccagtcaktgtccgtcctcctagcggg

SEQ ID NO: 117 - DNA, 304 bp, Homo sapiens
  CDS 141..302
  sig_peptide 141..245: Von Heijne matrix score 8.69999980926514 seq LLLSVAFNQLVFA/LY
tttctcatcaatttcttgcttctctggcaacctcaacctctgattcctgaggccaataaaactgaaactttctgcttgagctcttgttttgccaggctgatggggctgaggtgcaccctctgaggaaaagctgtaaatacatggattttacccaatgccattcccttcttttaagggttgaatattctccagtgtctgtctgctttttattactttccgttgccttcaatcagttggtttttgctttgtatccaatacaagctacwbtctgtttctctddagtttctctccctttccccgctca

SEQ ID NO: 118 - DNA, 145 bp, Homo sapiens
  CDS 76..144
  sig_peptide 76..120: Von Heijne matrix score 8.5 seq LLLLACGVPSLWP/FA
gtgaaggtaggagtgttggggccctgacccccgcaggagggatgggcggattcgaggactggctgcctgcccatcatgctcttgctcctgctggcctgtggtgttcccagcctgtggccctttgcwcttgctctcttaaagaccc

SEQ ID NO: 119 - DNA, 288 bp, Homo sapiens
  CDS 160..288
  sig_peptide 160..228: Von Heijne matrix score 8.5 seq SFLLLHLCQVLLS/RR
tctttagtcctgtttatatgatgaatcacatttattgatttgcatatgttgaaccatccttgtatcccagggataaagcctacttgattgtaatggataagcttcatgatgtgctgctgaatttggtttgccagtattttgttaaggatttttacatcaatgttcattgagaatattggvctgaagttttcttttttgttgttgcatctctgccaggttttgctatcaagacgagctggtaccattcctactgaaacaattccaaaaaaattgaggaggagagacggg

SEQ ID NO: 120 - DNA, 386 bp, Homo sapiens
  CDS 71..385
  sig_peptide 71..142: Von Heijne matrix score 8.5 seq XALLMGFLMVCLG/AF
aattctcttggagcaagcagggaagcagaggagcagcagggtcagggtgctgggttcctaaggtgcaaggatgcagaacagaactggcctcattctctgtgctyttgccctcctgatgggtttcctgatggtctgcctgggggccttcttcatttcctggggctccatattcgactgtcaggggagcctgattgcggcctatttgcttctgcctctggggtttgtgatccttctgagtggaattttctggagcaactatcgccaggtgactgaaagcaaaggagtgttgaggcacatgctccgacaacaccttgctcatggggccctgcccgtggccacagtagacagtgctgctcttctgaaaatcatgtgtaagcarttgcttt

SEQ ID NO: 121 - DNA, 190 bp, Homo sapiens
  CDS 34..189
  sig_peptide 34..165: Von Heijne matrix score 8.5 seq LTCTSSLLSFALG/RS
atcttgaaaacggaaaataaaaacagcagacctatgaaggtcgaaggggaagaaaagctgtatcgattgttgagatctggcgacttgtttaaatttcatcagcctcacttctatgaactctcaggcctcacgtgtaccagctctctgctctcctttgccttgggacgttccatccctggaagtttcccag

SEQ ID NO: 122 - DNA, 211 bp, Homo sapiens
  CDS 32..211
  sig_peptide 32..88: Von Heijne matrix score 8.5 seq LLLFSGAVALIQT/WA
agattctccccagacgccaaggttgcgggtcatggagtcccgaaccctcctcctgctgttctcgggagccgtggccctgatccagacctgggcaggtgagtgcggggtcgggagggaaaaggcctctgcgggaaggagcgaggggcccgcccggaggagtaaatctgcacatatakbtaattacagattacaattacaatcaaggcagggg

SEQ ID NO: 123 - DNA, 353 bp, Homo sapiens
  CDS 249..353
  sig_peptide 249..296: Von Heijne matrix score 8.39999961853027 seq SVPLLCFWSLCYC/FA
  misc_feature 187: n=a, g, c or t Oligonucleotide
agcgagtccttgcctcccggcggctcaggacgagggcagatctcgttctggggcaagccgttgacactcgctccctgccaccgcccgggctccgtgccgccaagttttcattttccaccttctctgcctccagtcccccagcccctggccgagagaagggtcttaccggccgggattgctggaaacncaagaggtggtttttgttttttaaaacttctgtttcttgggagggggtgtggcggggcaggatgagcaactccgttcctctgctctgtttctggagcctctgctattgctttgctgcggggagccccgtaccttttggtccagagggacggctggaagataagctc

SEQ ID NO: 124 - DNA, 249 bp, Homo sapiens
  CDS 93..248
  sig_peptide 93..134: Von Heijne matrix score 8.39999961853027 seq PWTILLFAAGSLA/IP
tttttccccgatctggcctcacaggaggagttggcggggagccttgggcccctctggcctcagccggatttcccagccaaacgcagagagagatgccctggaccatcttgctctttgcagctggctccttggcgatcccagcaccatccatccgggtggtgcccccgtacccaagcagccaagaggaccccatccacatcgcatgcatggccgctgggaacttcccgggggcgaatttcacactgtatc

SEQ ID NO: 125 - DNA, 375 bp, Homo sapiens
  CDS 175..375
  sig_peptide 175..366: Von Heijne matrix score 8.39999961853027 seq GFLFFGFLFPVFS/FP
gtgctgcggcattcacgtgatctgcacgggcgcagatgtaggcaccggtccgagtgcctgccctctgtccccgcggctgggtctcgtctgctccggttcctgggctcctaattcttggtccagcttcttccaggtcagtgtgcgggccttccacgctgccagcggaacactggaatggcggaaggggaacgggtctgcgcgtctgtkgttcccagcgctctgcgaacgctgaaaaggaggagcaacctgtccagaatccccgcaggacaggaaaaggaggggaaatctcgacatgttgctcccccttttcgctttttccctttttccggttttttgttttttggttttctttttcccgtcttttctttcccctcc

SEQ ID NO: 126 - DNA, 437 bp, Homo sapiens
  CDS 223..435
  sig_peptide 223..261: Von Heijne matrix score 8.39999961853027 seq MFCLAAILASASA/QR
  misc_feature 404: n=a, g, c or t Oligonucleotide
tcaatacccatgtgaacagtttcgtggagggttttaagtattttccactggctggctttgggtataagtacctttccttcttctgtcgttaaccacgccgaggggagaaaactatgcccccgtgaaagtccccactctgtttcggttggggaatactggagcttaacctcttggagggggttgttccataccaagggtccttccgtaggtatttctaatgggatgttctgcctggcagcaattttagcctcagcatctgcccaacggtttccttctgccttttctccttcacctttyygatggcttyrgcartgtaasactgccacctccttgggtttttrcactgtgtgyartaactccataatttccttgtggtatttaaygggrgttcccccagaggttanggaactccctttctttccatattgcagcatggg

SEQ ID NO: 127 - DNA, 304 bp, Homo sapiens
  CDS 24..302
  sig_peptide 24..74: Von Heijne matrix score 8.39999961853027 seq TLLLLLSEALALT/QT
ctcaggactcagaggctgggatcatggtagatggaaccctccttttactcctctcggaagccctggcccttacccaracctgggcgggctcccactcctkraagtatttccacacttccgtgtcccggmccggccgcggggagccccgcttcatctctgtgggctacgtggacgacacccggtcagagtattgggaccgggagacacggagcgccagggacaccgcacagattttccgagtgaacctgcggacgctgcgcggctactacaatcagagcgaggccgggtctcamaccctgcagtg

SEQ ID NO: 128 - DNA, 244 bp, Homo sapiens
  CDS 19..243
  sig_peptide 19..99: Von Heijne matrix score 8.39999961853027 seq LVLSLISLSIAWS/MV
  misc_feature 112: n=a, g, c or t Oligonucleotide
gcgattaggttttaatgtatgaatttcagggggccacaaacgttcagtctttcacacagccttgtgttatccctaatcagtctctccattgcatggtctatggtcgaaatgnbcacttctgcaagctacaarcaaaagtttgcccttagaatcctagttgtgcagttgcccacatgggtggaatgtccagtaaaccacaggtgtgcactagggagaaagaattgttctattaggacccagccac

SEQ ID NO: 129 - DNA, 232 bp, Homo sapiens
  CDS 156..230
  sig_peptide 156..215: Von Heijne matrix score 8.39999961853027 seq SCICLFLPSLIHS/FP
ctacaggaaggaaaagtgtgacagctttgaaaaagaaagagggtaaaatattttaaccacccttggtgtcatttgtggcagcctatagcattagagcctttgagaacagatctttccagattctgcttaagtccagggattctgtgaccgcagaaatgactggcatctccatctgctcgtgcatctgtttgtttcttccttcattgattcactcattccccccgccctgcgg

SEQ ID NO: 130 - DNA, 312 bp, Homo sapiens
  CDS 17..310
  sig_peptide 17..94: Von Heijne matrix score 8.30000019073486 seq FLLLVAAPRWVQL/QE
atgctttctgagagtcatggacctcctgtgcaagaacatgaagcacctgtggttcttcctcctgctggtggcggctcccagatgggtccagctgcaggagtcgggcccacgcctggtgaggcctccggagaccctgaagccttcggagaccctgtccctcacctgcactatttctggtgactccatgagcagtgcttcttactattgggcctggatccgccagcccccaggcaagggcctggaattcattgggcgtgccttatatagtgggaccaccgactacaatccgtccctcagcagtcgaatcaccct

SEQ ID NO: 131 - DNA, 276 bp, Homo sapiens
  CDS 119..274
  sig_peptide 119..253: Von Heijne matrix score 8.19999980926514 seq PLSLSLCLSLCHT/HT
gccttcatctctccatctctgcgctgctgccggctgcgccatccagcacccagactccagcaccggccgaggacccccactccggctgcagggaccctgtcccagcgagaccgcaggcatgtcatccgaaaagtcaggactcccagactcagtccctcacacttctccgccgccctacaatgcccctcagcctccagccgaacccccagccccgcctctctctctctctctctgtctctctctctgtcacacacacacacacacacacacacacac

SEQ ID NO: 132 - DNA, 174 bp, Homo sapiens
  CDS 35..172
  sig_peptide 35..118: Von Heijne matrix score 8.19999980926514 seq LVSLLMQPEGALG/EE
actctgctgagctcctctgcacctgcccaggaccatgacgcctgctctgcgctgcgcattcgctctggccatagcgggcctcgtgtcgctgctgatgcagcccgagggcgccctcggcgaggaggctgcaagtgccgcagcccagggccgccagttggctgaacttaggctcca

SEQ ID NO: 133 - DNA, 344 bp, Homo sapiens
  CDS 133..342
  sig_peptide 133..246: Von Heijne matrix score 8.19999980926514 seq LLLIFLSFPYTLC/IL
gcctttcacttgcacaaacactgttattatgatcacttatccaactgacatttttcagaccttttaacttcaactgttcttttttcctgtaaatcttaattttctttttttttctcccaatttttctcctacatgtctggactcttcccagttcctgtcagagtaaatgttgatattgcccagaacataacttgctcttccttttctctccttctcatttttctttctttcccctacaccctctgtatactctatagagtaaaatcatatacacccacggagtcaataactgcctttaatctaacaattgggwgattcccatatctttawwtttcwaccccggg

SEQ ID NO: 134 - DNA, 244 bp, Homo sapiens
  CDS 128..244
  sig_peptide 128..226: Von Heijne matrix score 8.19999980926514 seq HALSLCLCTCAFA/FL
aagcaagagaggggtgttcaggatgataaagtcctggttgatgaaggcagatgcctgcagctcttccctggggcagggctggcttccatagggtgcttgtttgggccctttggaagggggtgtgcggatgtgcagggctgcttgtatcattagaatggctgttagaatttcattctttctttcttaccatgctctgtctctctgcctttgtacatgtgcgtttgcatttctctccctcctcggg

SEQ ID NO: 135 - DNA, 217 bp, Homo sapiens
  CDS 40..216
  sig_peptide 40..90: Von Heijne matrix score 8.19999980926514 seq LLXALGFLXQVNP/XP
attaaaccaccaccagstccccaagccaccccttcagccatgaagttcctgctcctggmagccctcggattcctgamccaggtgaatcccarcccaattsmaggdgggtcaaaaatgtgtgagtwacaccccaggatactgcaggacatgttgccactggggggagacagcattgttcatgtgcaacgctkscagaaaatgctgcatcagytactcc

SEQ ID NO: 136 - DNA, 428 bp, Homo sapiens
  CDS 114..428
  sig_peptide 114..239: Von Heijne matrix score 8.10000038146973 seq LFCFLLLCLSAAS/LL
aggcgtctgtgtgcgccgccaagtcggtggggcggggacgcgaggtgtggatggggggtcgccttgacctctgcctcagccagtagcgcagtctcggcctcgccgttacggagatggtgccctgggtgcggacgatggggcagaagctgaagcagcggctgcgactggacgtgggacgcgagatctgccgccagtacccgctgttctgcttcctgctgctctgtctcagcgccgcctccctgcttcttaacaggtatattcatattttaatgatcttctggtcatttgttgctggagttgtcacattttactgctcactaggacctgattctctcttaccaaatatattcttcacaataaaatacaaacccaagcagttaggacttcaggaattatttcctcaaggtcatagctgtgctgtttgtggt

SEQ ID NO: 137 - DNA, 434 bp, Homo sapiens
  CDS 305..433
  sig_peptide 305..406: Von Heijne matrix score 8.10000038146973 seq LLCLFXLFFFSFL/KR
tttctgtccattctccctcaccaccctgacgcaggctctgggaatgtgctgaaggtgcagcagctgctccacatttgtagcgaacactttgactccaaagagaaggaggaagacaaagacaagaaggaaaagaaagacaaggacaagaaggaagcccctgctgacatgggagcacatcagggagtggctgttctggggattgcccttattgctatgggggaggagattggtgcagagatggcattacgaacctttggccacttggtgagtatagcatgaagaaaattggaatatactggttttgatggcctggggttccccagggaagatttttctgatgggttttcttggtggagagctggtctttttgctgtgccttttcttwctttttttcttttcttttttgaagcggagttttgctctagagtgcaatg

SEQ ID NO: 138 - DNA, 395 bp, Homo sapiens
  CDS 310..393
  sig_peptide 310..357: Von Heijne matrix score 8.10000038146973 seq SILLLLAPPLPSA/VS
  misc_feature 189: n=a, g, c or t Oligonucleotide
aaaagctctgtaaacatataataaatggaattccattgacattcaagccttacgtatttccagagcttcttcgacttatcctgcctcccctactttaattctgttaaagtagttgaacaccattcttctcataatagttctccctcsattcttcagtgattyccttgtgtttataggataaagtccacntgttattttggcagtcagttcaagatccacaaatcagtctttacccttacatccttatttctcactgctgttctaatatagtctttataccagtcaggctggtctgttcactattcctgaatgtttttctccattcttttgttattggcacccccgctaccctctgcagtgtctttgctacctttctttttctactgtgtgcaggg

SEQ ID NO: 139 - DNA, 268 bp, Homo sapiens
  CDS 141..266
  sig_peptide 141..206: Von Heijne matrix score 8.10000038146973 seq LLVCSWLSISLHA/HT
caactctgctgttttgtaggaagccacatggaggtcatttacggttactagttatcttagtcagcttgggcagccattaaaaaataatactgtagacggagtggcccaaacgagagaaatttatttcttatagttttggcatggtagatttcatcctgaggtctcttctcttggtttgtagttggctgtcaatctccctgcatgctcacacgaccgctttttgtacatacagtaagaaaatacacactgtcatgtcatttttttgtaa

SEQ ID NO: 140 - DNA, 170 bp, Homo sapiens
  CDS 93..170
  sig_peptide 93..140: Von Heijne matrix score 8.10000038146973 seq LLYFLCVSSYVTS/FF
ttttgactgatatcaaattctaggtggaccgagattttctttcagtctttcaaagatattactctattgccttctatcttgcatagtttctgatgagaagtctgttgtatttcttatgtgtttcttcatatgtaacatcttttttctttttttttttttttttttttttt

SEQ ID NO: 141 - DNA, 396 bp, Homo sapiens
  CDS 192..395
  sig_peptide 192..236: Von Heijne matrix score 8 seq FISFLCLIALAGT/SS
gattctcagcttagttgctgttggtgtataggagagctactgatttgtgtacattaattttgtatccggaaactttgttgaattattttatcagttctaggagctttttggaggagtctttagggttctctaggtatacaatcatatcatcagcaaacagtgacaattcgacttcctctttatggatttgtatgccctttatttctttcctttgtctgattgctctggctgggacttccagtactatgttgagaagtgctctggctgggacttccagtactatgtkgargagaagtggtgamagtgggwatcctkghctkgtycmagtcctmagagggaatgctttcagctttttcccattcagtctgatgtwggctatgggttgtcatagatggc

SEQ ID NO: 142 - DNA, 357 bp, Homo sapiens
  CDS 292..357
  sig_peptide 292..339: Von Heijne matrix score 8 seq FLLGAIFIALSSS/RI
cgtgcctgcgcaatgggtgtcgggtccgctttttcccaatccggacgtaatcgtggtttttgttctgcaataggcggcttagagggaggggctttttcgcctatacctactgtagcttctccacgtatggaccctaaaggctactgctgctactacggggctagacagttactgtctcagctctaggatgtgcgttcttccactagaagctcttctgagggaggtaattaaaaaacagtggaatggaaaaacagtgctgtagtcatcctgtaatatgctccttgtcaacaaatgtatacattcctgctaggtgccatattcattgctttaagctcaagtcgcatcttactagtgaag

SEQ ID NO: 143 - DNA, 159 bp, Homo sapiens
  CDS 26..157
  sig_peptide 26..151: Von Heijne matrix score 7.90000009536743 seq LVCVCVCVCVCXC/XR
tgtgtgtgtgtgtgtctgcgtgtgtatgtgtttgtgtccctgctgggatgtgtttactgtgtttgtgtgtgtctctgtgtgtgtgtctgtgtctgtccctgtcgggatgtatttagtgtgtgtgtgtgtgtgtgtgtgtgtgtgtstctgcgygcgtgg

SEQ ID NO: 144 - DNA, 433 bp, Homo sapiens
  CDS 282..431
  sig_peptide 282..383: Von Heijne matrix score 7.90000009536743 seq LFSLLMLTQSPLA/GQ
  misc_feature 132,149: n=a, g, c or t Oligonucleotide
aaaataaggtatctggcaaaagaatatatgaaagagtatgaagaactctccttgaaagctgtggcccccattggccatggctgcagagccgatgtcccggccaatccaggcgggatccccttgaagcmggknsmwhbtcykragscwknccmabtctccgggggcaastcttttcccttccctgtgaccckcttcggacagttgaccatctcaacacctagtggttaaaaagaagagcatggacggcctggggcctgcactggctgtgctgggagtttgtcatgttgatagctaagcaggcccagccccaaggcctcactgccatctgcttccctctcacacctctcttctccctcctcatgctcactcagagcccccttgcaggtcaggaaggaagagaaggagggaaagaacggtacttgttggtgattca

SEQ ID NO: 145 - DNA, 200 bp, Homo sapiens
  CDS 15..200
  sig_peptide 15..92: Von Heijne matrix score 7.90000009536743 seq RVCLLSLSLFLWA/NR
aatacgccaggaacatgctaaggacctggagctctctaccctggacccgttttcgggtttgcttgctctctctctctctctttctctgggctaatcgtttagaggacagtcgctcctgccaacctaatcccatgagcctgactaccttgccgggccacaggctcaaagaagcagtgtggctgccagcaccctcacttggg

SEQ ID NO: 146 - DNA, 297 bp, Homo sapiens
  CDS 80..295
  sig_peptide 80..166: Von Heijne matrix score 7.90000009536743 seq LVVXWLLPXQCSC/ER
aacaccccagcccaagttcatccccggtcccttggcagcagtgcgcatccacaaagccagcggcacaatttaattactgatggcccctttcctacgacaggtggatrtgtggggagcacaggccggtctggtggtbgsmtggttactaccatgscaatgcagctgtgaacgatcagagcaatatctgagcacctgtctcccacagcactcaagcatcaagcagtcgtgcatcaagcatccagcaggcccgatccccgcaggccacctacagggaaaggccacagctgcgcccctggg

SEQ ID NO: 147 - DNA, 300 bp, Homo sapiens
  CDS 80..298
  sig_peptide 80..136: Von Heijne matrix score 7.90000009536743 seq WLFLVAILKGVRC/EV
agctctgagagaggagcccagccctgggatcttcaggtgttttcactcggtgatcaggactgcacagagagaactcaccatggagtttgggctgaagtggctttttcttgtggcaattttaaaaggtgtccggtgtgaagtgaagctggtggagtctgggggaggcctggtgcagccgggggggtccctgagactctcctgtgtaggatctggattcgtcttcgataaatatggcataagttgggtgcgccaggcaccaggaaagggcctacagtgggtcgcggggatcggtggcggggg

SEQ ID NO: 148 - DNA, 405 bp, Homo sapiens
  CDS 21..404
  sig_peptide 21..68: Von Heijne matrix score 7.90000009536743 seq AMLVLVVSPWSAA/RG
gcggtcttccagcagggaaaatggcgctggccatgctggtcttggtggtttcgccgtggtctgcggcccggggagtgcttcgaaactactgggagcgactgctacggaagcttccgcagagccggccgggctttcccagtcctccgtggggaccagcattagcagtacagggcccagccatgtttacagagccagcaaatgataccagtggaagtaaagagaattccagccttttggacagtatcttttggatggcagctcccaaaaatagacgcaccattgaagttaaccggtgtaggagaagaaatccgcagaagcttattaaagttaagaacaacatagacgtttgtcctgaatgtggtcacctgaaacagaaasrtgtcctttgtgctactgctatgaaaa

SEQ ID NO: 149 - DNA, 146 bp, Homo sapiens
  CDS 56..145
  sig_peptide 56..115: Von Heijne matrix score 7.80000019073486 seq LLLFPLSLLFTLG/FL
aaaccttctgactactaacctgtagatccctttagttccttagcagtattcacaaatgtttttctactcacactttttacttctttttcccctctcgttacttttcacacttggatttttgtttgtcttttttttttttttttttt

SEQ ID NO: 150 - DNA, 408 bp, Homo sapiens
  CDS 105..407
  sig_peptide 105..242: Von Heijne matrix score 7.80000019073486 seq LVLLGTRVPLSGG/GP
aaacagggccattggcaaagctggggtaccagtcacccagccacgctctagggtggtagccaagaagacggaccccgagtgggaggcagagagacaagaggtggatgaagcagagcaagcgtgasatggtgaagagaagacggagccccgcgctgggagaggaacgcttcagtccgagttccattctgcacccaaggctccccttggtcctcctgggaaccagggtgccccttagtggtggtggcccaggagaacccgaccaaggcaggagcgccccctcctggaagagcctcgcttcaacgcatmatcattcccggccggcagcaggggcgacgccagcaaggcctgcgactcagagccagcttggcccgttcgccccgccccttcccggtgtccgccccgccccat

SEQ ID NO: 151 - DNA, 166 bp, Homo sapiens
  CDS 69..164
  sig_peptide 69..122: Von Heijne matrix score 7.80000019073486 seq LCVLSLLVSFKSA/CL
cacattttctacttaaaagcaamgttacaaagcctgtggaattgctctgacttagaaagaacttgatcatgcttttggagtctctatgtgttctctctctgttggttagttttaaatcagcctgcctcacaagggagcctgcatttgattcccaagcccgcccggg

SEQ ID NO: 152 - DNA, 382 bp, Homo sapiens
  CDS 99..380
  sig_peptide 99..236: Von Heijne matrix score 7.80000019073486 seq LLYLSFAALGVVA/LR
ttttacacacacacatacatacacacacacagctaattgagttttaaagtaatattcttgctaatccctactgaattgtagcttggtgttgtttctgaatggtttttggatattggaagcagccgctgattacccttgcaaagaaatctgtaaaatgtgcacgtgaatgtctgagatgctctctcaggcctctagtccttctgtatctttcctttgcagccctgggtgtagtagcactcaggagtgttgaatcacccctggccgagacccactcctgctggctcagcctgggcatgtgtgtgctccagtgtgaacagcagtgggttccaaccccagtctcctttctctgtggcctctctggctccagcaccatcatcgttag

SEQ ID NO: 153 - DNA, 208 bp, Homo sapiens
  CDS 10..207
  sig_peptide 10..81: Von Heijne matrix score 7.80000019073486 seq CVYVVCLVSCVLC/VV
tgcaatgtcatgtgtgttgtgtgcagtgtgcatggtgtgtgttgtgtatatgtggtgtgcctggtgtcgtgtgttttgtgtgtcgtgtgtcctgtgtgttgggttatgtgttgtgtgtggtgcatctgtgtgtgtgtgtggtgtgtctgttgtatgtgttgtgtgttgtcatgtgttgtgtcacatgggttgtgtggtgtgtcatggg

SEQ ID NO: 154 - DNA, 251 bp, Homo sapiens
  CDS 73..249
  sig_peptide 73..129: Von Heijne matrix score 7.80000019073486 seq WVFLVAVLEVVQC/EI
agagaggagcctcagccctagactccaaggcctttccacttggtgatcagcactgagcacagaggactcaccatggaactggggctgtcctgggtcttccttgttgctgttttagaagttgtccagtgtgaaattcaactgattgacgccgggggaggccacgtccaggcgggggggtcactgagactctcctgtgttgcctctgacttcctgtttagaagctattggatgacctgggtccgccatccggg

SEQ ID NO: 155 - DNA, 147 bp, Homo sapiens
  CDS 24..146
  sig_peptide 24..140: Von Heijne matrix score 7.80000019073486 seq ILLFLFLILFIWH/IR
ggattttgtcaaatgctttttctatgtcgattttgctgagggttttaggcataaagggatgctggattttgtcaaatcctttttctgcatgtattgagatgatcttgttatttttgtttttaattctgtttatatggcacattcggg

SEQ ID NO: 156 - DNA, 141 bp, Homo sapiens
  CDS 61..141
  sig_peptide 61..135: Von Heijne matrix score 7.69999980926514 seq LVPILLLIGWIVG/CT
gctggataacaaaagaaagaggtaagcgtggcctgacctagccacccaccaacaggaataatggctgaaaaagcggggtctacattttcacaccttctggttcctattcttctcctgattggctggattgtgggctgcacc

SEQ ID NO: 157 - DNA, 115 bp, Homo sapiens
  CDS 12..113
  sig_peptide 12..68: Von Heijne matrix score 7.69999980926514 seq RLYLWMCLAAALA/SF
ctcaagaagccatggcggaatccaggggccgtctgtacctttggatgtgcttggctgctgcgctggcatctttcctgatgggatttatggtgggctggtttattaagcctctggg

SEQ ID NO: 158 - DNA, 175 bp, Homo sapiens
  CDS 54..173
  sig_peptide 54..131: Von Heijne matrix score 7.69999980926514 seq FLLLLYFFXIAVT/HP
caattcaacatgagatttagtggtgacaaatatccaaactctatcaacctctaatgctgacctcactgcctttcctcctgcccaccatcagctttctcctcctcttgtatttttttcmaattgctgtcacccatccgtcagttctcatcaacttctctttctccttccccagatc

SEQ ID NO: 159 - DNA, 230 bp, Homo sapiens
  CDS 121..228
  sig_peptide 121..180: Von Heijne matrix score 7.59999990463257 seq LLFFTCGLPALHG/DS
  misc_feature 18: n=a, g, c or t Oligonucleotide
aggaggggccgtcagggngggatacagcctggaaggtgcgtgtggggctgggtctcggagtgggagacgtggagtgcaggtaatgcatgtccatggtacacaaattcacaaggtttgtaaatgagaaaagacgtgaggttccttttgttctttacctgtggcctccctgccctacacggggactctagggtggaatgtagcaaagcccatccaccagccatgtactaccc

SEQ ID NO: 160 - DNA, 346 bp, Homo sapiens
  CDS 202..345
  sig_peptide 202..282: Von Heijne matrix score 7.59999990463257 seq WTLLSISLSVFWS/EP
ttcttctacatacagctacccaactagcccacaccatttattgaatacagagtagtcttttccctgttggttatttttcttaactttgttaaagatcagatatctgtaggtgtgcagctttatttctgggttttctgttccgttccattggtctatgtgtctgtttttgtaccagtaccatgctgttctggcaccagtaccatgctattttggttaccatctccatctgagaccacttcagcctggactttattgtccatatcactatcagtattttggtcagagccattcaataagtctctaggaagttccaaactaccatgtcattttttttctataaaacggg

SEQ ID NO: 161 - DNA, 388 bp, Homo sapiens
  CDS 194..388
  sig_peptide 194..334: Von Heijne matrix score 7.59999990463257 seq LXLGEGLTFLCLC/QV
  misc_feature 352: n=a, g, c or t Oligonucleotide
agtgagagcttagtcttggtactatttgtttttgtttcttactgtttgtctgtttatggttggttgcaagaaaattgtgttgtaaattatcccttgctttctctattagttaatagccttccccttctgtagtaaagtaamsagscttttkcctgttcaaatattttaggcttgttttttgttttgattgtacatgcctgtgtgtttttattccttaatttgtttctttatttatttctgtttgttatctccaagagaaacaatagaagaggtggccctcttccagttttctctgcthmtcttgggagagggtctcacctttctttgcctctgccaggtaatgacgaataanatgcaactgctgttcttgagtggggtagtctgtggg

SEQ ID NO: 162 - DNA, 235 bp, Homo sapiens
  CDS 172..234
  sig_peptide 172..210: Von Heijne matrix score 7.5 seq MAPLLLSLSCSFS/CH
cccctccaaatctcatgttgagatttgatccctaatgttggagatggggcctggtgggagatattcggatcatgagggcagatccctcactaatggcctggtgccctccctgtggaaatgagtaagttctcactcttttggttcacctgagagctgtttgtttaaaagagcatggcacccctccttctctctctgtcttgctccttttcttgccatgtgacactcctgccccggg

SEQ ID NO: 163 - DNA, 240 bp, Homo sapiens
  CDS 99..239
  sig_peptide 99..158: Von Heijne matrix score 7.5 seq LLWVLLLNLGPRA/AG
aaaacgacccggtgggtctacagcggaagggagggagcgaaggtaggaggcagggcttgcctcactggccaccctcccaaccccaagagcccagccccatggtccccgccgccggsgcgctgctgtgggtcctgctgctgaatctgggtccccgggcggcgggggcccaaggcctgacccagactccgaccgaaatgcagcgggtcagtttacgctttgggggccccatgacccgcaggg

SEQ ID NO: 164 - DNA, 195 bp, Homo sapiens
  CDS 20..193
  sig_peptide 20..91: Von Heijne matrix score 7.5 seq LISELLLLRSVTS/HN
ttctgattatgatggtaatatggtattctgggaaatatctgtccaaattatcctgatctctgaactcctgctgttgaggtcagtcacttcacacaataccatgatgagagctttatcaagccagatgcttagtcagagctttccaagacccagctttggttttatcagcaaaatccatccttcccacccccccaa

SEQ ID NO: 165 - DNA, 256 bp, Homo sapiens
  CDS 34..255
  sig_peptide 34..186: Von Heijne matrix score 7.5 seq VVSLTFLLGMTWG/FA
  misc_feature 18: n=a, g, c or t Oligonucleotide
tatttatgtgacctgtgngggtattttggagtcatgttttttctgaacattgccatgttcattgtggtaatggtgcagatctgtgggaggaatggcaagagaagcaaccggaccctgagagaagaagtgttaaggaacctgcgcagtgtggttagcttgacctttctgttgggcatgacatggggttttgcattctttgcctggggacccttaaatatccccttcatgtacctcttctccatcttcaattcattac

SEQ ID NO: 166 - DNA, 209 bp, Homo sapiens
  CDS 36..209
  sig_peptide 36..86: Von Heijne matrix score 7.5 seq FLFLFLLXXLIVA/VT
cttttttdtcckgcacaagggatttccgggtcaggatgaacaaacacttcttgttcctcttcctccttdackgcctcattgtggcagtgacatcacttcagtgcataacatgccaccttcgcacacggacagaccgctgtagaagaggctttggtgdctgtactgctcagaagggcgaggcatgcatgctcttaaggattcaccagcgc

SEQ ID NO: 167 - DNA, 184 bp, Homo sapiens
  CDS 44..184
  sig_peptide 44..148: Von Heijne matrix score 7.5 seq LLLTSHFLGESLG/GG
taaagtcctgtgtatgacatgacatagtatttgcgtaatttaaatgtacataaagatggagtctgtcaccttgtcaccagccccagtcttccccgtccctgcacarctccttttactgacatcccattttctaggcgagtcccttggtggaggcacactgcttgtcccactcctccccccaggg

SEQ ID NO: 168 - DNA, 218 bp, Homo sapiens
  CDS 97..216
  sig_peptide 97..177: Von Heijne matrix score 7.40000009536743 seq ILLLTICAAGIXG/TR
ccttccctccgcgcacaggctgccggctcaccgcttgctaatggcagccggggtctccctgggacagcaagacctccgctcaggcccctctttcgaatgckccamgcmctcctgcgatctagaatgattcagggcaggatcctgctcctgaccatctgcgctgccggcattrgtgggactcgtcagtttggctataacctctctatcatcaatgaccc

SEQ ID NO: 169 - DNA, 480 bp, Homo sapiens
  CDS 317..478
  sig_peptide 317..457: Von Heijne matrix score 7.40000009536743 seq SCLFSXAWLXCXC/HG
gtctcgtgggctggtccccagcggctccctccccgaacagctgctgctccagggaggaagcggcgyrrgtgmtgtccagcttcccggtgctgaaaaccggagggctcgtcatccaccactaccatgtaagggccatgagaagggctcatcctggcgcasgcggacatggaggaggacttattccagctaaggcagctgccggttgtgaaattccgtcgcacaggcgagagtgcaaggtcagaggacgacacggcttcaggagagcatgaagtccagattgaaggggtccacgtgggcctagaggctgtggagctggatgatggggcakctgtgcccaaggagtttgccaatcccaccgatgatactttcatggtggaagatgcagtggaagccattggctttggaaaatttcagtggaagctgtctgttctcamtggcttggcttkgatgctsatgccatggagatgatgatctcagcat

SEQ ID NO: 170 - DNA, 280 bp, Homo sapiens
  CDS 135..278
  sig_peptide 135..179: Von Heijne matrix score 7.40000009536743 seq LLQLLAFSFLGNS/VE
  misc_feature 104: n=a, g, c or t Oligonucleotide
ttctttgggctcgggggctcccggagcagggcgagagctcgcgtcgccggaaaggaagacgggaagaaagggcaggcggctcggcgggcgtcttctccactccntgccgcgccccgtggctgcagggagccggcatggggcttctccagttgctagctttcagtttcttaggtaattccgtggaaacggtgcggggaggcggacggacttgggcatggggaaggaaaacccaaaagctgcttgctcaccttcgtgggatcctgggggcttgggasaggga

SEQ ID NO: 171 - DNA, 103 bp, Homo sapiens
  CDS 28..102
  sig_peptide 28..69: Von Heijne matrix score 7.40000009536743 seq LVLVHSSLSKTLS/QK
actgggatgcagaggctgcagtgagccatgttggtgctggtgcactccagcctgagcaagaccttgtctcagaaaaaaaaaaagttcacaaascccaccaggg

SEQ ID NO: 172 - DNA, 218 bp, Homo sapiens
  CDS 73..216
  sig_peptide 73..129: Von Heijne matrix score 7.40000009536743 seq LILVISCLLLAFE/CV
caattttgttgatcttttcaaaaaaccagctcctggattcattaattttttgaagggttttttgatgtctctatgtccttcagttctgctctgattttagttatttcttgccttctgctagcttttgaatgtgtttgctcttgcttttctggttcttttaattgtgatgttagggtgtcaatttcggatctttcctgctttctcttgtggggcaaggg

SEQ ID NO: 173 - DNA, 380 bp, Homo sapiens
  CDS 295..378
  sig_peptide 295..360: Von Heijne matrix score 7.40000009536743 seq CLXVFLLTDRTLS/CR
tattggttattctagttatacattagtctaaatttttttcaaagttttcaacttctttgcctttggtttgaatttcctcctgtagcttggagtagtttgatcatctgaagctttcttctctcaactcatcaaagtcattctccatccagctttgttccattgctggtgaggaactgtgttccttcggaggaggagaggtgctctgcttttttgagtttccagtttttctgctctgttttttccccatctttgtggttttatctacttttggtctttgatgctggtgatgtacagatgggtttttggtgtggatgtcctttctgtttgtwagttttccttctaacagacaggaccctcagctgcaggtctgttggagttgc

SEQ ID NO: 174 - DNA, 139 bp, Homo sapiens
  CDS 59..139
  sig_peptide 59..103: Von Heijne matrix score 7.30000019073486 seq LLSLSLWGISTLS/ST
ataacagaatgatttacattcctttgggtatatacccagtgatgggatatatgtgtcaatggtattactgtctttaagtctttggggcatctccacactgtcttccacaacaattgaactaatttacacccccatcggg

SEQ ID NO: 175 - DNA, 122 bp, Homo sapiens
  CDS 38..121
  sig_peptide 38..112: Von Heijne matrix score 7.30000019073486 seq LLHVHSFLPPVFS/TQ
ctacctgtccttgcgcaccacccttgtctgggccttcatggcctctctcctgagtggctttactagcttctgtcttttgcacgttcactctttcctccctccagtgttttccacccagaatg

SEQ ID NO: 176 - DNA, 300 bp, Homo sapiens
  CDS 175..300
  sig_peptide 175..264: Von Heijne matrix score 7.30000019073486 seq AILLXXWEAGSEA/VR
  misc_feature 51..52,63,239: n=a, g, c or t Oligonucleotide
aaaaactctaaaagaaggacgcattttaggtaagatctagtggctagatcnncagggtgggcnkcgttcttgtggaaatcagtcaagaaagatcggattcgcggttatttatgcaaatcatctgggtggattgtgtacggagttaaactgcgccttctggaccgggtctgaacaatggagactgcgctasaatkaacgccacagaaaaggcaagttatgtttcttgctatattgttgcnttwgtgggaggctggctctgaggcagthaggtattccataccagaagaaacagaaagtggc

SEQ ID NO: 177 - DNA, 466 bp, Homo sapiens
  CDS 268..465
  sig_peptide 268..372: Von Heijne matrix score 7.30000019073486 seq LDLLGSSSPPTSA/SQ
cttaaactttattatgttgkkttcacaaagagcagcctttgttgactttgaaatcattgcttcagtattctagaaaatcttgtttttgttaaacatgggcagtaacttactatttttgtatagttgttgtwcatcktacccccaccctgttttaaaaataaaaagtagttgtcagattactttggctttagaagtaccttttcacttgccttagaatcttcattactttgagcctacactccacctcttattggaacttcatgaagaatgatgttggatttcgctctgtcgcccaggctagagcgcagtggtctgatcatggcttgctgtacccttgacctcctgggttcaagcagtcctcccacctcagcctcccaggtggctgggactgggcatgtgccaccacacccagctagttttttttactttkttgtawgacaggtctactatgtttcgcagctgatct

SEQ ID NO: 178 - DNA, 222 bp, Homo sapiens
  CDS 30..221
  sig_peptide 30..95: Von Heijne matrix score 7.19999980926514 seq QVFFLVFPDGVRP/QP
acgtcggacccggaggccctgaatgccccatgcgcaccccacagctcgcgctcctgcaagtgttctttctggtgttccccgatggcgtccggcctcagccctcttcctccccatcaggggcagtgcccacgtctttggagctgcagcgagggacggatggcggaaccctccagtccccttcagaggcgactgcaactcgcccggccgtgcccggactccggg

SEQ ID NO: 179 - DNA, 171 bp, Homo sapiens
  CDS 33..170
  sig_peptide 33..95: Von Heijne matrix score 7.19999980926514 seq SWPLLAAVSGLRG/LE
ccttttgccttcaaccttcgagccgccacgtaatgccacgtccccgcgcatgcgcatcttggccgctgctggcggctgtttccgggcttagagggctggagtggccgccgagttggaggcgggtggtggcagcagtaggagtgtgtagagtgcgggattgggggccccggg

SEQ ID NO: 180 - DNA, 245 bp, Homo sapiens
  CDS 177..245
  sig_peptide 177..227: Von Heijne matrix score 7.19999980926514 seq FLLLISVLTVIWF/WK
tgtaattttccttgccaaaaagcttagtttcatcttttataaatatcctataatgccaagttgattgcatggtcagagtgaatctgtgctgtacccawattcagtagccttctcctatccaacaaagtgttttgtaaataggaggtaaatgaatgagtggatggatggagggatgaatgaatggaattttcttgctcttgatctctgtcttaacagtgatttggttttggaagacacacccgggg

SEQ ID NO: 181 - DNA, 241 bp, Homo sapiens
  CDS 160..240
  sig_peptide 160..213: Von Heijne matrix score 7.19999980926514 seq XLLCIIXLYLIRG/SE
gttgacttttctctctgctgaggcagaaaaatgcttccatagtccatgcagcaatgtttaaaacaagggatttcgttcccccctcvccttttgtgtaggctggttaataaactctgtgtttywtagcattgtcgtgaawattcagagtgctccctgcgaatggttttcctagtakctctgttgtgtatcattkctctttatttgattcgtggttctgagtggamcctaccaccgaactggg

SEQ ID NO: 182 - DNA, 263 bp, Homo sapiens
  CDS 103..261
  sig_peptide 103..156: Von Heijne matrix score 7.19999980926514 seq LFFLLRIALASWA/LF
gggttatctaacctgttccattgttccgtgtatcagtttctgtaccgataccatgctgttttggttactgtagtcttgtagtatagtttaaagtcagatagcatgatgactctagctttgttctttttgcttaggattgctttggctagttgggctctcttttggatccatatgaattttagaagagcttttttccacttacggtggtttgatatcaatagcactgaatctgtaaattgctttgggcagtatggcctagcggg

SEQ ID NO: 183 - DNA, 170 bp, Homo sapiens
  CDS 60..170
  sig_peptide 60..146: Von Heijne matrix score 7.09999990463257 seq SLLVFCLNDLSNA/VX
ttccatgtggagatgrraagaatatatattctgtggttattgggtagagtgttctatagatgtctattaggtctaattggtctagtgtcgaatctaagtctagaatttctttattagttttctgcctcaatgatctwtckaatgcwgtcargwggggmattgaartcccc

SEQ ID NO: 184 - DNA, 443 bp, Homo sapiens
  CDS 83..442
  sig_peptide 83..130: Von Heijne matrix score 7.09999990463257 seq IPLFLGVLAYCTG/SV
ctttccagcaaggggataagagaggcctggaagaacctgcccagcctgggcctcaggaagcagcatcggaggtgcctcagccatggcatggatccctctcttcctcggcgtccttgcttactgcacaggatccgtggcctcctatgagctgactcacccaccctcagtgtccgtgtccccaggacagacagccagcatcacctgctctggagataaattgggggataaatatgcttgctggtatcagcagaagccaggccagtcccctgtgctggtcatctatcaagatagcaagcggccctcagggatccctgagcgattctctggctccaactctgggaacacagccactctgaccatcagcgggacccaggctatggatgaggctgactattactgtcaggcgtgggacagcagcactgtggtattcggcggagggacca

SEQ ID NO: 185 - DNA, 427 bp, Homo sapiens
  CDS 332..427
  sig_peptide 332..418: Von Heijne matrix score 7.09999990463257 seq FCFXLCFGRSSLC/CR
taagtttatayhtctgaatctgaaatcagaatatatatatttaatttttcaattttaaaaatgttaccctgtgtgagacaaaacaaaacagtgactagaaccctccttgtgggctaaatttgagtttgcttcttcataatgttttaaatgcttcacaaacatttttctttggtatattgagcaaaatgaattgaagtatatttactgagtgatgattattgaggaaaaactcaaagatctgctgtaagcactagagttgaaggactagcccaacagctcctcaggcacctttgggtatattgagttgccccccctgactttgaacacatctatggtctgtgtcatcttcaaagagctcatggaatttgaattccctgggttttgtttttghctttgttttggacggagctcgctctgttgccgarac

SEQ ID NO: 186 - DNA, 365 bp, Homo sapiens
  CDS 130..363
  sig_peptide 130..219: Von Heijne matrix score 7.09999990463257 seq SCLALXTLAVVYA/AL
aacgagtctttgggaacgtggtccacccagggatgtaaaactgtgcttaccgatgcatcccatacgaaatgcttatgtgatcgtctctctaccttcgccattttggctcagcaacctagagaaataatcatggaatcctctggcacaccttcagttaccctaatagtaggcagtggtctttcttgcttggccttgatbaccctagcagttgtctatgcagcattatggmggtacatacgctctgagagatccataatactaattaacttctgcctgtctatcatctcatccaatatcctcatactggttggacagactcagacacataataaagagtatctgcacaaccaccactgcatttttgc

SEQ ID NO: 187 - DNA, 260 bp, Homo sapiens
  CDS 86..259
  sig_peptide 86..178: Von Heijne matrix score 7.09999990463257 seq LXFLASSFCFGEA/DS
  misc_feature 143: n=a, g, c or t Oligonucleotide
ttttggaacagggtaggcattttgtttattgtttgcttgcttctaggtgttttcgccatcagggtgtattggaggctgacacttaatgggtgtgtgttgcgcccagaactgctcggtgtcggggktcwaaagraatgcgctgntgttcttggcttcaagtttctgctttggagaagcagattcaggaagtaggtgttgcttaaaaataattcttggtttttatctaatcagatattcattgattacctaccaggtgcgtg

SEQ ID NO: 188 - DNA, 172 bp, Homo sapiens
  CDS 52..171
  sig_peptide 52..105: Von Heijne matrix score 7.09999990463257 seq LFFFLKWSHPGWS/AT
  misc_feature 112: n=a, g, c or t Oligonucleotide
ttaatggaatatattatagtacactagcatgctggaaagaatgaaaataatatgaaaattctttacctttttttctttttgaaatggagtcacccaggctggagtgcaacgncgtggtcttggcacactgcaacctccgcctccctgattcaagtgattctcccgccttggg

SEQ ID NO: 189 - DNA, 150 bp, Homo sapiens
  CDS 47..148
  sig_peptide 47..124: Von Heijne matrix score 7.09999990463257 seq LFLSGCFLFLSXC/XI
tatcacwtctaagagatttctggtgaaacttgtggattttctatacatgacaccatgttttctgcaaatggacaatttgactcctcttttcctatctggatgctttttatttctctctcwttgcwtgatttatttggctaggattttggg

SEQ ID NO: 190 - DNA, 339 bp, Homo sapiens
  CDS 195..338
  sig_peptide 195..314: Von Heijne matrix score 7 seq ITCKLCLCEQSXG/QD
agtcttgcaaagtgtaaagctgtcagccgcagagcacggaggaaagacggagagaatggaagagctcctgtccggtgtgccagcagcccggactggcggtgagcgcgagggaggctackgagaagcccggcgacggaggaacgcaggtctgctgccagggattgaggagactgaagaacgctgaagacaggctgatgggctcagctggtaggctccactatctcgscatgactgctgaaaatcccactcctggagacctggctccgkcccccctcatcacttgcaaactctgcctgtgtgagcagtctcrtggacaagatgaccacactccaggaatgc

SEQ ID NO: 191 - DNA, 359 bp, Homo sapiens
  CDS 96..359
  sig_peptide 96..242: Von Heijne matrix score 7 seq VTVLLSAAPCLLS/CF
  misc_feature 340: n=a, g, c or t Oligonucleotide
tacaagagtttttgctgaaagttttaagttgataagatgcagagaattgggggaatgtataataaatcaggtttcattgttatattatttaccacatgaatcaccttcctcctaaccattataggmgccatgtgttcacatgtcatgtggaccagtatttaactgtggaaaccgcgggtggcatggagaaggaggcagtgtccgtgactgtgctgctctccgcagccccctgcctgctgtcctgtttcctcggctcctcggtgtctggactggcgttctgggtttcccagcagaaaactaaagggccagagaggtgtaaaaacacacaccactbggcagntaataatttccccgcgagg

SEQ ID NO: 192 - DNA, 264 bp, Homo sapiens
  CDS 138..263
  sig_peptide 138..257: Von Heijne matrix score 7 seq FLFMLPLWCSIGT/CT
ttgagcttaaggccaggtatatgggctcacacttgtaatctcagtgctttgggaggctgagggaaaaggatagcttgagtccaggagttcgagatcatcctgggcaacatagcaagatcctgtctctacaaaacctaatgaacaaaattaaagaaaacacacacacacacacacacacacacacacacaaaaacaacaccaaactagtgtcaaacctattcctttttatgttacctctctggtgctccattggcacttgcacag

SEQ ID NO: 193 - DNA, 301 bp, Homo sapiens
  CDS 147..299
  sig_peptide 147..272: Von Heijne matrix score 7 seq LFLYSLFTENVLA/HP
tgtattgtttmmmttatttactagtatgcagatctggttttcattcttttcatattgaatttcgttatgggtagaatcatttgcaaacatttctagacatttttaaagatctatttaatttgtttaagaatggaaaacataaaataatgcatgattcttcaggcaagaataatttcagaaagatacctgttgtaaatttaatttatctctatgtagacatacatatacataaattatttttatatagtctctttacagaaaatgtattggcacatccttgcattgttctacgccgcctatg

SEQ ID NO: 194 - DNA, 215 bp, Homo sapiens
  CDS 105..215
  sig_peptide 105..203: Von Heijne matrix score 7 seq LFFLFVGPFSCLG/SY
gctctgactgcagcctcccagggaatgcgcggccgagggaatgcgcgcagtcacaggccctgggagtgagctggtgcccggcgacctggcacccgcgcctggatatggggcgtctacatcgtcccaggagcagcaccagctacaggaacctgccgcatctgtttctgtttttcctcttcgtgggacccttcagctgcctcgggagttacagccgg

SEQ ID NO: 195 - DNA, 209 bp, Homo sapiens
  CDS 78..209
  sig_peptide 78..158: Von Heijne matrix score 7 seq RLLLLLLLXLPLP/PP
  misc_feature 73..74: n=a, g, c or t Oligonucleotide
tcattcactgattagatccagcgctgagaggcagcactgctccttctctcacgccaactgagtctcttgatcnntacatgcaatcccaggcagctcgcgaacacaaacccgggghcagccgcctactgctgctgctgctgctgcwgctgccgctgcctccgccggkvctgcgaacccgggdyttttcawgcaccacactcaccgcmggg

SEQ ID NO: 196 - DNA, 363 bp, Homo sapiens
  CDS 287..361
  sig_peptide 287..331: Von Heijne matrix score 7 seq LWSLACLSPPAVQ/LG
ttacattgtaatatataaataattatacaactcaccataacgtagaatcagtgggagccctgagcttgttttcctgcaactagatggtcccaactagaccaggtgatgggagacaatgacagatcattaggcattagattatcataaggagcatacaacctagatcccttgcatgtgcagttaataataggttttgcacttctatgaggatctaatgcggcctctgatctgacaaggggcggastcaggcagtaatgggagcaatggggagcggttttcaatacagatgaggctttggtcacttgcctgcctttcacctcctgctgtgcagcttggttcccaacaggccacggactggtggtc

SEQ ID NO: 197 - DNA, 155 bp, Homo sapiens
  CDS 58..153
  sig_peptide 58..132: Von Heijne matrix score 7 seq IFSFFFFITLVRG/SI
tagtgttattcatagtagtatctgaagaccttttgtattcttgtgggatcagttgtaatgtcacctttgtttattctgattgtgcttatttggatcttctctttctttttctttattactctagttagggggtctatcaatcttttttttttttt

SEQ ID NO: 198 - DNA, 135 bp, Homo sapiens
  CDS 60..134
  sig_peptide 60..125: Von Heijne matrix score 7 seq STFLFFLFFSVFC/FF
ttgcctcttaaaaggccacacttcttaatactatcaaattggctattaagtttcaacaaatgaatttggggggacattcagatcatagcacttttcttttctttctttttttttctgttttttgttttttttttt

SEQ ID NO: 199 - DNA, 320 bp, Homo sapiens
  CDS 46..318
  sig_peptide 46..108: Von Heijne matrix score 6.90000009536743 seq VTFLLALVGAVLY/LY
  misc_feature 9: n=a, g, c or t Oligonucleotide
gctggagcngccgatccgagacgtggcthcctgggcggcagaaccatgttggacttcgcgatcttcgccgttaccttcttgctggcgttggtgggagccgtgctctacctctatccggcttccagacaagctgcaggaattccagggattactccaactgaagaaaaagatggtaatcttccagatattgtgaatagtggaagtttgcatgagtbcctggttaatttgcatgagagatatgggcctgtggtctccttctggtttggcaggcgcctcgtggttagtttgggcactgttgatgtactgaagcagcatcgggg

SEQ ID NO: 200 - DNA, 125 bp, Homo sapiens
  CDS 40..123
  sig_peptide 40..93: Von Heijne matrix score 6.90000009536743 seq LELLGSSSPPISA/SQ
cttcctcagtcacccaggctggagtacagtggcataatcatggctcactgcagcttagaactcttgggctcaagcagtcctcccatctcagcctcccaaagcactggaattacaagcgtgagcca

SEQ ID NO: 201 - DNA, 210 bp, Homo sapiens
  CDS 78..209
  sig_peptide 78..128: Von Heijne matrix score 6.90000009536743 seq LLLLSLSLFLFFW/RQ
tcaggttttcctccttcccgggtgctctgaagtttcaccatgaatcaccttgcaggggctctttttattttttattgatgcccagccagttgttgttgttgtctctttctctctttttgtttttttggagacagagtctcgttttgtggcccaggctggagtgcagttgtgtcattgcggctcactgcagcctgacctcccaggctcggg

SEQ ID NO: 202 - DNA, 338 bp, Homo sapiens
  CDS 89..337
  sig_peptide 89..226: Von Heijne matrix score 6.90000009536743 seq CLFCCXFISSCNS/VF
  misc_feature 291: n=a, g, c or t Oligonucleotide
aattataataatatactaaaatatgtacgaatatatactaataattagtatataatgaatcagtataaaatatataatatacactaatatgtatactaataaatatacactaatatataacatactaatatataatatatgtbtkdrgtatatgtggttgatactcatttatatgtacctacatatttgcctcttttgttgcwcttttatttcttcctgcaattctgtgtttccctgtgtgattatbtttcttctgcctgaagaacttctttwtgtdtwtctdwdwdtgtntttywttgtgagatggagtctcamtcwgtcgtccaggctggagtgca

SEQ ID NO: 203 - DNA, 188 bp, Homo sapiens
  CDS 84..188
  sig_peptide 84..176: Von Heijne matrix score 6.90000009536743 seq LWSLIQAVHICLG/RK
tattctctgattckctgtcttggaatgcatttaaaatctctgcctcgattctgacctacctggcatgggaacaagaatttacaatgttactcacccacaatgaagattacatgcctggcaatttdgrcttwarddawttgtggagcttaattcaggctgttcatatctgcctaggcaggaaaaaaaaa

SEQ ID NO: 204 - DNA, 347 bp, Homo sapiens
  CDS 81..347
  sig_peptide 81..137: Von Heijne matrix score 6.90000009536743 seq WVFLVAIIKGVQC/QV
agctctgggagaagagccccagccccagaattcccaggagtttccattcggtgatcagcactgaacacagaggactcaccatggagtttgggctgagctgggttttccttgttgctattataaaaggtgtccagtgtcaggtgcaactggtggagtctggggggggcttggtcaagcctggagggtccctaagactctcctgtgcagcctctggattcaccttcagtgaytacwawatractkggattcgcmaggcccmagggaagggsytgraktggattycatamatwacgactagtgggaataccgcaawytacgcagwctctgtaaaggsccgattcaccatc

SEQ ID NO: 205 - DNA, 440 bp, Homo sapiens
  CDS 276..440
  sig_peptide 276..326: Von Heijne matrix score 6.90000009536743 seq FLFVCLXFDESCS/VT
cagtaaatttttttgwwcattggttccttcdkcttggactctctgttagcacacctgatcagagttggccgtgttgtaattctttccctctctgctgcaatgttgtttacttctacctgscaactawkctttatactttccttttttgccatgaagggaatacattttttccttcttgttgggctatacagtgatcctcatcaacaaattatcaaagaactgtatgaggaaaaggtctctttttttaaaagtgaatcagggctggggagttaggaatgaagaggttttttttgtttgtttgtttgtwwtttgacgagtcttgctctgtcaccaggctggggtgctgtggcgcgatctcagcccactgcaamctccgactccctggttcaagcratdytcctgcctcaacctcccgagtagvygggattacaggcatgcgc

SEQ ID NO: 206 - DNA, 283 bp, Homo sapiens
  CDS 162..281
  sig_peptide 162..275: Von Heijne matrix score 6.90000009536743 seq CMLFVSFLLLLLG/SR
aataactccctttagcatttcttgtaggacaggtctgatgttgatgaaatctctcatcttgtttgtcagagaaagtctttatttctccttcatgcttgaaggatgtttccaccggatatactatcctagggtaaaagtttttttccttcagcactttaaatatgtcatgccactctcttctggcctgtaaggttttcactgaaaagtctcctaccaaacatattagagagcaccattgtatgttatttgtttcttttctcttgctgcttttaggatcccgggg

SEQ ID NO: 207 - DNA, 264 bp, Homo sapiens
  CDS 113..262
  sig_peptide 113..190: Von Heijne matrix score 6.90000009536743 seq LLSMLSCCQGACC/PS
gacggcggagagcagagagggagcgcgccttggctcgctggccttggcggcggctcctcaggagagctggggcgcccacgagaggatccctcacccgggtctctcctcagggatgacatcatccgtccacctccttgtcttcaaggaccacctcctctccatgctgagctgctgccaaggggcctgctgcccatctacacctcacgagggcactaggagcacggtttcctggatcccaccaacatacaaagcagccacacaggg

SEQ ID NO: 208 - DNA, 422 bp, Homo sapiens
  CDS 352..420
  sig_peptide 352..408: Von Heijne matrix score 6.80000019073486 seq LLSMFCVSHTVQT/AT
  misc_feature 289..290: n=a, g, c or t Oligonucleotide
aaaataaaagtcttcttgatttccagtgtattcctcctgcacwttttggcctgtttggaccacagatttgtggctttttatgaaatacacctgtagattaatttwcagttthtwhayggwagtagacagtcaaaggctagatcactgtratgagtagggcttccacatttaagaaaaagctgtaatgaagtgaattgaatcttgcttcttttgggtcacccaaaagcagtgataagtgctgagtgtgttaggcacttattaacaaaagtaactcagaattgctgtctanncctccatatcttttttcttctctccgtgtagttctaaaaatgaccatatgatattccttgaatggtaagagcgtctattcttcttagcatgttctgtgtgtcacacactgtgcagacagcaacatacacaca

SEQ ID NO: 209 - DNA, 195 bp, Homo sapiens
  CDS 39..194
  sig_peptide 39..89: Von Heijne matrix score 6.80000019073486 seq ALSSFTWWAPACC/AP
agccactgcacctgggctcacagtttaaatcttgagtaatggagaaaacagccttgtcatcctttacgtggtgggcacctgcctgctgtgctccacgtacatacgtggtgtctgcaacaactctgtcagctgtgcaaggtcactgtcctctacagagtagaacatcgaccaaaggaaagttatggccgtttgggg

SEQ ID NO: 210 - DNA, 363 bp, Homo sapiens
  CDS 212..361
  sig_peptide 212..280: Von Heijne matrix score 6.80000019073486 seq KLLLSGLTQECLG/AL
taattttcatcatctaaactgaatgcaaacagcgcttggcaattaaaatgaagctctccaatgaagtatacttcatcagctgctgtcaagtcatccattgatactgttttgcggtttttaaattccttttgtcactgtgactgctcatcagcaggcaaggaagagcaggcaacaaaagttgaaaagtgcatgaaggaaaactttgaggaatatgatattcacattccagcaaattgggggaaaactgctattatctggtttaacacaggagtgccttggtgccctgcctgaggctaatgtgttctgtaggggtggctgcacagccacagtcctgaaacatgggaaagcatctcctgagtccag

SEQ ID NO: 211 - DNA, 368 bp, Homo sapiens
  CDS 230..367
  sig_peptide 230..322: Von Heijne matrix score 6.80000019073486 seq LLALSPDLQAARG/LM
acagagaaccctgcttcaaagcagaagtagcagttccggagtccagctggctaaaactcatccchyggataatggcaacccatgccttagaaatcgctgggctgtttcttggtggtgttggmatgggtgggsacmrgkwgggbkgyvackgtcatgcctcagtggdrragtgtcggccttcattgaaaacaacatcgtggtttttgaaaacttctgggaaggactgttgatgaattgcgtgaggcaggctaacatcaggatgcagtgcaaaatctatgattccctgctggctctttctccggacctacaggcagccagaggrctgatgtgtgctgcttccgtgatgtccttcttggctttcatgatgg

SEQ ID NO: 212 - DNA, 448 bp, Homo sapiens
  CDS 316..447
  sig_peptide 316..435: Von Heijne matrix score 6.80000019073486 seq LLKLLISLRSFWA/ET
ttgtcttggctatacgggatcttttttggtcccatatgaaatttaagtagcttttcctaattctgtgaaggaagtcaatggtagcttgatgggaatagcattgaatctataaattactttgggccgtatggcatttgggcaatattgattcttcctattcatgagcatggaatgtttttccatttgttcatgtcctctcttattttgttgagcagtggtttgtagttctccttgaaggggttcttcacatcccttgtaagttgtattcccaggtattttattctctttgtagcaattttgaatgggagttcactcatgatttggctctctttttgtctattattggtgtataggaatgcttgtgatttttgcacattgactttatatcctgggactttgctgaagttgcttatcagcttaaggagtttttgggctgagacgacggggg

SEQ ID NO: 213 - DNA, 158 bp, Homo sapiens
  CDS 28..156
  sig_peptide 28..102: Von Heijne matrix score 6.69999980926514 seq LVGSLHLFLSVLA/SK
gcgctgggagttctctttttcacttgaatgttttcttctccagggctgaggacgctctttgtattggtaggcagcctgcacttgttcctttcagtcctggcaagtaaaagcaggaattctaaaaagcaacgattattcctcctagttcctttgtacag

SEQ ID NO: 214 - DNA, 193 bp, Homo sapiens
  CDS 39..191
  sig_peptide 39..107: Von Heijne matrix score 6.69999980926514 seq NVCSLPAPGLCSG/QP
aagaaaagctttgggtcaactcagcatcatgtttgcagatgctgacagacgggatcctaatgagagtcaatgtgtgctcactgccagctcctgggctgtgctctggtcagccaggtgtgagggcctggcctggggtcacacagctgactcarbtagaggaatgcccatggttctcagcattggaaggactggg

SEQ ID NO: 215 - DNA, 214 bp, Homo sapiens
  CDS 67..213
  sig_peptide 67..165: Von Heijne matrix score 6.69999980926514 seq ILLLSLIFGPCIL/NS
aaagttcgagaaaatchagataggcaccaacaagaacgagaaaataacatcccctggtatcaaagcatgtttaactggaacccatggctaactactttaatcactgggwtagchggacctctcctcatcctactattaagtttaatttttgggccttgtatattaaattcgtttctkaattktataaaacaacgcatagcttctggcaaacggg

SEQ ID NO: 216 - DNA, 327 bp, Homo sapiens
  CDS 22..327
  sig_peptide 22..108: Von Heijne matrix score 6.69999980926514 seq FCALLLSLXXXXP/XX
ctccgcgttccagaatccaagatggcgggatccaggcaaaggggtctccgggccagagttcggccgctgttctgcgccttgctgctgtcactmsgwhsvmtycktccgrkgckacgscgtgkgaggagaccccgcggtcgcgttgccacatcgccgtttcgagtasaaatacagcttcaaggggccgcacctggtgcagagcgacgggaccgtgcccttctgggmccacgcggggaatgctattccaagttcagatcaaattcgagtagcaccatctttaaaaagcyaaagaggctcagtgtggvmaamgacaavagcggacctggg

SEQ ID NO: 217 - DNA, 357 bp, Homo sapiens
  CDS 70..357
  sig_peptide 70..126: Von Heijne matrix score 6.69999980926514 seq WVFLVAILKGVHC/DV
aggagccccagccctgggattcccagctgtttctgcttgctgatcaggactgcacacagagaactcaccatggagtttgggctgagctgggttttccttgttgctattttaaaaggtgtccactgtgacgtgcagctggtggagtccgggggaggtttagttcagcctggggggtccctgagactctcctgtgcagcctctggactcaccctcagtaacgactggatgcactgggtccgccaagccccagggaaggggctggtgtgggtctcacacattgatagttctrggactatcacaaattacgcggactccgtgaagggccgattcaccatctccagagacaacgccaagtgg

SEQ ID NO: 218 - DNA, 189 bp, Homo sapiens
  CDS 74..187
  sig_peptide 74..118: Von Heijne matrix score 6.69999980926514 seq LFLGFLACSVAYQ/CH
ttatcaaggacactgtcttttcgccatcatgtgttcttggcccctctgttgaaattcaatctatcatagacaaatgggtttatttctgggctttctagcctgttctgttgcataccagtgccattctgcttttgttactgtagcttcacagtacactttgaaatcagagactttgatgcccgcagcggg

SEQ ID NO: 219 - DNA, 353 bp, Homo sapiens
  CDS 41..352
  sig_peptide 41..187: Von Heijne matrix score 6.69999980926514 seq FLGLIFFLELATG/IL
agttgacttgccatctgccttgcaggatggcatccagcccatgtgggaggacagcaggaataaacggggtggccgctggctggtcagcctggccaagcagcagcgccacattgagctggaccggctgtggctggagacgttctccgtgttcctcggtctcatcttcttcctggagctggcaacagggatcctggcctttgtcttcaaggactggattcgagaccagctcaacctcttcatcaacaacaacgtcaaggcctaccgggacgacattgacctccagarcctcattgactttgctcaggaatactggtcttgctgcggasccgaggccccaatardtggaaccgggg

SEQ ID NO: 220 - DNA, 115 bp, Homo sapiens
  CDS 12..113
  sig_peptide 12..53: Von Heijne matrix score 6.59999990463257 seq FLSLSTAFWVVYA/MI
actagcatttcatgtttttatctctctctactgcattctgggtagtttatgccatgataatttattcagctctctctgctggatttattattttctttttagttgtgtttaatct

SEQ ID NO: 221 - DNA, 142 bp, Homo sapiens
  CDS 29..142
  sig_peptide 29..130: Von Heijne matrix score 6.59999990463257 seq FFLFFCFETGSHS/VT
cctgcccattgcttcaacctgcacctctatgtacattgtgatggatctacctctatggctctcccatgaggtccaatcttatattccttctttcttcctttttttttgctttgagactgggtctcactctgtcacccacggg

SEQ ID NO: 222 - DNA, 370 bp, Homo sapiens
  CDS 209..370
  sig_peptide 209..289: Von Heijne matrix score 6.59999990463257 seq LAFSFSFFPSSFS/SF
ttttggatacatatgactcatgtgacattagatcacagcatttttgtttttattattaatatattgccttagaactacattgctaaacctggtctttgtatctgcgaagttctaacatcttgccacagcttagttagctttgagagggaaagggtagaatccatttaaggagacaggttaaaaaatgatatatttaagcatataggcaatggtagcacatgattaccaaaacataattagccttttctttcttgctttttcattttctttctttccttcttcattttcttctttctttcttktctttctttcttttttctcttctttctttctctctcttctttctttcccttccttcctcccccccggr

SEQ ID NO: 223 - DNA, 431 bp, Homo sapiens
  CDS 22..429
  sig_peptide 22..66: Von Heijne matrix score 6.59999990463257 seq ALRALCGFRGVAA/QV
gcagtctgcagccggagtaagatggcggcgctgagggctttgtgcggcttccggggcgtcgcggcccaggtgctgcggmctggggctggagtccgattgccgattcagcccagcagaggtgttcggcagtggcagccagatgtggaatgggcacagcagtttgggggagctgttatgtacccaagcaaagaaacagcccactggaagcctccaccttggaatgatgtggaccctccaaaggacacaattgtgaagaacattaccctgaactttgggccccaacacccagcagcgcatggtgtcctgcgactagtgatggaattgagtggggagatggtgcggaagtgtgatcctcacatcgggctcctgcaccgaggcactgagaagctcattgaatacaagrcctatcttcaggcccttccatactttga

SEQ ID NO: 224 - DNA, 282 bp, Homo sapiens
  CDS 132..281
  sig_peptide 132..215: Von Heijne matrix score 6.5 seq LVFLHLFLXVYLG/LV
attttaaagtgtttctgttaatgtattctacttcagtcccccaaaattccaactaacgacatacatgaataacagatcatgactgctgtttctacaagcctttctgctcactgtgcttccacttacaactcatgttaatatggtcttcctcttcttttcctgcaccccctctctttcttgtctttcttcatcttttccttmwtgtctatttgggtcttgtcatgcccactcaacagtatctcctcctgcagagtccattgatgttcacagacaaagcccagc

SEQ ID NO: 225 - DNA, 198 bp, Homo sapiens
  CDS 26..196
  sig_peptide 26..163: Von Heijne matrix score 6.5 seq WLFFLMLSLCTPP/DR
acttttgctttatgttcaggggtccatgtgtaggatgtgcaggtttgttacatggataaacgtgtgccatggtgatttgctgcacagatcatcccgtcgcctgggtgtgaagccgagcacgcattggctattcttcctgatgctctccctttgcacccctcctgacagaccctggtgtgtgttgttccccccgctggg

SEQ ID NO: 226 - DNA, 141 bp, Homo sapiens
  CDS 21..140
  sig_peptide 21..113: Von Heijne matrix score 6.5 seq LSLSLPLSLXLLX/XP
gcagttgakrdsacttggtaatgtsaacgcaagaagcaggcttgatytttttttctccccccttctctctctctctctctctctctctycctctctccctctytctcctctstsacccacactcacgcacacctcaaaggg

SEQ ID NO: 227 - DNA, 206 bp, Homo sapiens
  CDS 77..205
  sig_peptide 77..115: Von Heijne matrix score 6.5 seq MEFLLLWSLXSNG/KR
awcaartacttgttaagcrtttacgatgtgccaggttctgtgctaggtgctgagtgtacattgttgarccaaacagatggagttcctgctattgtggagtttgcmgtctaatgggaagagaggccaggcatggcggctcatgcctgtwgtcccagcagtttgggagcctgaggcaggtggattgcttcagctcgggggttctaggg

SEQ ID NO: 228 - DNA, 480 bp, Homo sapiens
  CDS 216..479
  sig_peptide 216..326: Von Heijne matrix score 6.5 seq LLVFFLIVRTLSC/RS
gcatccccckktagctcagagaagtttgttrdgaccgatcttctgaagcctacttctgtcaactcatcaaagtcattctccatccagctttgttccattatgggtgaggagctacgatcctttggaggagaagaggcactctgatttttagaattttcagcttttctgctctggtttcgccccatctttgtggttttatctaccttcggtctttgatgatggtgacctacagatggggttttggtgtggatgtcmtttttgttgctgttgatgctattcctttctgtttgttagttttctttctaatagtcaggaccctcagctgcaggtctgttggagtatgctggaggtccactccagaccctgtttgcctaggtatcaccagcagaggctgcagaacagaaatattgcagaacagcaaatgttgctccctgatccttcctctggaagcttcgtctcaaaggggcactgaatgtatga

SEQ ID NO: 229 - DNA, 144 bp, Homo sapiens
  CDS 43..144
  sig_peptide 43..99: Von Heijne matrix score 6.5 seq EIFLPFSLSPANA/QS
tccagatgtgatttggtatttcatactttgttgcttttgtaaatgctgtacccactgcctgagatattcttacctttttctttgtccccagcaaatgcccagtcaaaatttagcctttatttttttcccttggtgaagccgggg

SEQ ID NO: 230 - DNA, 457 bp, Homo sapiens
  CDS 314..457
  sig_peptide 314..394: Von Heijne matrix score 6.40000009536743 seq RLLCLXFXRLLLG/TS
  misc_feature 118,258..259,303,440: n=a, g, c or t Oligonucleotide
agctccgcggtaatggaggctagggatgggtgctgaagtatcaggctctggctctagctttagctctggcactggaactgcgtcggagtctgggtctgagtctggcagcccgaagccntggrmcaccttttcttgattctctaaggcgggggctgcctgcgtccaagcagctggtttgcagcgttccaacgctgggagggagttcccttacctggggtccagtctgtaaagttgtcgccgctttctagggacccgccnndscggctgggactcttccatgcgtgagtattactgarstgctsnaaggtccggcatgtccctggaacctgcctcggscctcttgggtgtgcggcggagactgctttgtctamctttctsccgacttctcttaggraccagtctgttgaagtttgtggkctcctgsagyccacccamaccgnatactctcacctcttcc

SEQ ID NO: 231 - DNA, 112 bp, Homo sapiens
  CDS 12..110
  sig_peptide 12..83: Von Heijne matrix score 6.40000009536743 seq LSVLILCVCVCVC/VY
ctgattttkctatgytgattttgtatctkgcaactttactaaatttatcagttctaatactttgtgtgtgtgtgtgtgtgtgtgtgtatgatttatatatawaaaggggagt

SEQ ID NO: 232 - DNA, 359 bp, Homo sapiens
  CDS 8..358
  sig_peptide 8..55: Von Heijne matrix score 6.40000009536743 seq LGTTVLLWSLLRS/SP
  misc_feature 326: n=a, g, c or t Oligonucleotide
gataatcatggcgcccctcggaacaactgtattgctgtggagcctcttgaggagttctccgggcgtggaacgggtctgtttccgggctcgaatccagccctggcacggtggcctgctccaaccgctaccttgctctttcgagatggggctgccacgccgccggttcagctccgaggccgcagaatctggtagcccagagaccaagaaacctacatttatggatgaggaagttcaaagcatactcacgaaaatgacaggcttgaacttgcagaagacttttaagccagctatacaagaactgaagccaccaacctataagctaatgnctcaggcacagttggaagaggctacaagacagg

SEQ ID NO: 233 - DNA, 301 bp, Homo sapiens
  CDS 4..300
  sig_peptide 4..105: Von Heijne matrix score 6.40000009536743 seq LLFVVLLPPPPGS/VX
  misc_feature 124,129,162: n=a, g, c or t Oligonucleotide
gcgatgctcctcactttcagctccagctcccgccaccgccgcctctatcgccgccgccgccaccacctcctcttcgttgtcctccttcctcctccgcctggcagcgttgktctctgcagcsggnrmgrnsmvraagtgctrvbgkmasgaaagttccggganggactacatggagccatgctccctgggctcttccgcgggcgcccgcgcgctgcccttcgcttgagagtctcaccgwgttgcccaggctggaaagtggcgcgatctcggctcacagcaacctccgcctcmcgggmccggg

SEQ ID NO: 234 - DNA, 248 bp, Homo sapiens
  CDS 152..247
  sig_peptide 152..190: Von Heijne matrix score 6.40000009536743 seq MLLLLQLNLKTLS/SS
acaagttgggtgctgtcgcctgcgcatcggcgggccgggaggctgagcagtactgttgagagcggtgtgaggtgcttggtagcgcgccgtagctgcttccacgtccttgcttcacctcaggtaaagagagaagtaatggaaggcctgtctgatgttgcttcttttgcaactaaacttaaaaacactctcatccagtaccatagcattgaagaagataagtggcgagttgctaagaaaacgaaagaggg

SEQ ID NO: 235 - DNA, 393 bp, Homo sapiens
  CDS 339..392
  sig_peptide 339..383: Von Heijne matrix score 6.40000009536743 seq LFVLLIITQLLYG/GI
gttccaaagtgagctgtctctggcagcattcatatagaatagaatttgaatggtgcacccagatttgaacaacatggtaatcatgtgatggacatggaaaagtgractaacbtkrgggatcwtggtarggtcaytaagaataactckaatcawgatgttaaaaggctttcctttacattcacaaaacaatttrsttcctagaagtagtttattcttgcctgtggtcatttttgctcctttataatactacatctaaatcaatttgttaaatatagtagagaaatgaaataaatttcttccagttaaaccactgcacttaaagagtagaaaccctctctatgtcactctttgttttgttgatcataactcaactgctgtatggtgggatactct

SEQ ID NO: 236 - DNA, 222 bp, Homo sapiens
  CDS 121..222
  sig_peptide 121..204: Von Heijne matrix score 6.40000009536743 seq ILFLGVLLSASDL/CV
ttttgagttaatttttgtataagttgtaaggattaggtcagggttcttaagaaaaatattgttttggtctatagatgtctcattgcttctgtgctatttgttggaaaagctgttcttccaatgaattgcttttgcaattttgtcaaaaccagtgaggcatatatgattctgtttctaggtgttctactctctgcaagtgatttatgtgtctatcccatcggg

SEQ ID NO: 237 - DNA, 154 bp, Homo sapiens
  CDS 54..152
  sig_peptide 54..95: Von Heijne matrix score 6.40000009536743 seq SVILALWEAEAGG/SP
agtcttttgctcctgtggttaagattattctgctaggctgctcacggtggctgatgtctgtaatcctagcactttgggaggccgaggcgggcggatcgcctgagatcgggagttcgggaccggccgcaccaacatggagaagccccgtccaggg

SEQ ID NO: 238 - DNA, 439 bp, Homo sapiens
  CDS 255..437
  sig_peptide 255..341: Von Heijne matrix score 6.30000019073486 seq LGCLLLAVRSSAT/VN
  misc_feature 359..360,381: n=a, g, c or t Oligonucleotide
tcaccacaatcaattttagaacattttcatcatcccgaaaataagccctgttccctttagctgtcactccccactcctaccccccagccctgtgcaataatctactttctgtctttgaagctttgcctattctggacattttgtataaaagggtttgtggaggatgtggtcttttgtgactggcttcttgaacttggcatagtgttttcaaggttcaaccatgttgtagcacgtacgttcctttttatggccaaatgtacggagagtccacattgtttatccattcatcagttcatgggcatttgggttgtctcctcttggctgttaggagtagtgctactgtgaacattacgtacchnnkwgtktgtgtggacattcaknttcatttccatatgcttatgtctggaattactgggtcatatggcaactctctttcact

SEQ ID NO: 239 - DNA, 229 bp, Homo sapiens
  CDS 7..228
  sig_peptide 7..159: Von Heijne matrix score 6.30000019073486 seq WLYLLEVVAPLSG/IH
gtcaagatggcggcgtctgtattaaacaccgtgctgaggcggcttcctatgctatctctcttccgaggttctcacagagttcaggtaactcttcgaaagacattttgcacaacctcaagttggttataccttctcgaggttgtcgctccactgtcaggaatccacgagtggagaccttcccacgtgtgtcttagctgtctaggcagtacttcctgcaacccccctgagg

SEQ ID NO: 240 - DNA, 318 bp, Homo sapiens
  CDS 65..316
  sig_peptide 65..259: Von Heijne matrix score 6.30000019073486 seq LMVVAETSQGSWS/AP
  misc_feature 259: n=a, g, c or t Oligonucleotide
ctcttcggttgtccagcccttctcccagccctggtccctcagaaggagggtaactcccttccagatgttacggtccgcctgcgtctctcagcacgccggtggcatttgggttgaccgcggaggcccccagtgccagagggtgttcacgttctgccgtgggctcagcccaaactttggacgctcagagacccaacgggagcgctggataaggccaggacagctgatggttgtggcagaaacatctcaaggtagctggtcngcccccacttccccatstacctcttgtcctccccccaacaccascaccacaccggytcc

SEQ ID NO: 241 - DNA, 405 bp, Homo sapiens
  CDS 123..404
  sig_peptide 123..257: Von Heijne matrix score 6.30000019073486 seq GFVSLLVVHAADA/WV
tagctggacccgtctgggaggtaggtttgtgagcgtgagagaksgatctgtaccgcggggatccgaagtatgcttatccaggtgggctgcctcaagcctcgatcccacccccgcgctdvtagatggtgtcaaggtccttgcgtgggagaaggacttgggtgagatgcatgcggagattgcccccaattccggcctggagccaagggaaagggatgcctggatttgtgtctctattggtggtccacgctgcggatgcctgggtagcccagaggttrtctacgccatacttctcactgtttttgagcatacctagatgttcctttcctaggcggagtatagatcgcacgtgttctagcstcttagactcagagggttcgagctctataascccctccactcccttca

SEQ ID NO: 242 - DNA, 242 bp, Homo sapiens
  CDS 129..242
  sig_peptide 129..191: Von Heijne matrix score 6.30000019073486 seq SLLPCSLISDCCA/SN
cttttgttttgcaatgccctgcccccagaggtggagtctacagaggcaggcaggcctccttgagctgaggtgggctccacccagttcgagcttcccagctgctttgtttacctactcaagcctgggcaatggtgggcgcccttcccccagcctcgcttctgccttgcagtttgatctcagactgctgtgctagcaatgagcgaggctccatgggcgtaggaccctctgagccacggcgyggg

SEQ ID NO: 243 - DNA, 363 bp, Homo sapiens
  CDS 298..363
  sig_peptide 298..357: Von Heijne matrix score 6.30000019073486 seq LGSLIASLAPSTG/LG
accactctgaggagacgcgtgacagataagaagggctggtgggatcagtcctggtggtagctcaggaagcagagcctggagcatctccactatggcctgggctccactacttctcaccctcctcgctcactgcacaggttcttgggccaactttatgctgactcagccgcactctgtgtcggagtcgccggssgaagacggtaaccatctcctgcacccgcagcagtggcagctttgtcagcaactatgttcagtggtaccagcggcgcccggacagtgcccccaccactgtgatctatgaggatgacaaaagaccctctggggtctctgatcgcttctctggctccatcgacaggtcttggg

SEQ ID NO: 244 - DNA, 324 bp, Homo sapiens
  CDS 153..323
  sig_peptide 153..236: Von Heijne matrix score 6.30000019073486 seq FFLFLFFXEXXXX/XX
aattgatactgctttagatgtttctgtctcattttacaaaaatgtaagaaaaaagaaaaatcaaactatactgttacctatttcttgtatattcttaacagaatgttctgtacacataagtgtatgtgtgttaatcctcttgtttaaatgccatgaaacttcagtttgccttttgttattttctttatttagataccttttttctttttcttttttttttkgagamagyctkgcyckgtkgchtaggmaggagtgcagtggcamaacctcagctcaytgcagcctccaccttckggttycaagcaattttyctgccccagckgg

SEQ ID NO: 245 - DNA, 280 bp, Homo sapiens
  CDS 27..278
  sig_peptide 27..233: Von Heijne matrix score 6.30000019073486 seq GILKVLLFSVVSG/LE
gttgcggggcggggccttcgcagagcatggcggcgggcgagcttgagggtggcaaacccctgagcgggctgctgaatgcgctggcccaggacactttccacgggtaccccggcatcacagaggagctgctacggagccagctatatccagaggtgccacccgaggagttccacccctttctggcaaagatgagggggattcttaaggtactgctcttttctgtagtctccggcttggagcagaaccccttggccgctggcttcagactctcccacccggg

SEQ ID NO: 246 - DNA, 211 bp, Homo sapiens
  CDS 70..210
  sig_peptide 70..162: Von Heijne matrix score 6.30000019073486 seq SLILSPSPRPVLG/FF
tttggctggggagacccatctggactaccaaggagaagctatagactacttctactccaccaggaaggtatgatgatgtcaaacgtgatgctgatgctacagttacagcccctgctggcgcastctctgattctctctccctctccgcgtccagtgctgggctttttcagacaagtgcatctcctaaccaggtcacatttcagccgctggg

SEQ ID NO: 247 - DNA, 359 bp, Homo sapiens
  CDS 249..359
  sig_peptide 249..308: Von Heijne matrix score 6.19999980926514 seq LLFICPPPPPISA/SS
tttcagaattttgtgcaggaatatctgagtatttctaattagattagaatgtcagaatacattcatggacatatgaggggttttttaaaattttttttagatatccttcaccttgaacatttattatttctttgtgttgggaacaatccaaatctctcctagatgttttgaaatgtgcaatgtattgttagctgtagtcaccctactgtgctattgaatactagagcttgttccttctgtctaactgtatgattatactcattaaccaacttctcttcatctgtcccccacctccacccatctcagcctctagtaactaccattttactctctacctccatgacattaacttttttagc

SEQ ID NO: 248 - DNA, 236 bp, Homo sapiens
  CDS 182..235
  sig_peptide 182..226: Von Heijne matrix score 6.19999980926514 seq DVLLQLLLRVCSP/RT
attgggttaatttcactgcactgactatttttagatatatattctttgtgccttcactagaactcctcttacttcatgatatcttaactataaaatcatccaaccatgaaaacaagcacacaagaaacagaaacaaaacagtcacaaaaaagcataaactgttagcattgatccatgatgaatgactgatgtattacttcaattgctattaagagtgtgttctcccaggaccaggg

SEQ ID NO: 249 - DNA, 342 bp, Homo sapiens
  CDS 266..340
  sig_peptide 266..304: Von Heijne matrix score 6.19999980926514 seq MGLFLCCSLLIFC/LV
taggctatttcttaattttccttctaggattcttatagtttgaagttttacatttagatcgtcaatccatcttgagttcatttttgtatatgatgaaaagtaggggtctgattttattcttctgcataagaccagttatcccagaaccgtttgttgaataggaagttcttttctcattgcttgtttgtggggactttgtcaaagatcaaatagttataggtgtgtggctgtatttcagggtttctttattccatttcactgatctatgggtctgtttttgtgctgctctttactgatattctgtctggttgttctaatcataactgaactgggctatggggg

SEQ ID NO: 250 - DNA, 382 bp, Homo sapiens
  CDS 291..380
  sig_peptide 291..332: Von Heijne matrix score 6.19999980926514 seq GSWALTWLHPAEA/GT
  misc_feature 264..265,279..280: n=a, g, c or t Oligonucleotide
atacagcggcctctgacaccagcacagcaaacccgccgggatcaaagtgtaccagtcggcagcatgggtaaggagaggggtttccaatcacccattgcctgctctgtctgcccctaatttggaaaggccctcctccagaaaatgctagaaaacctgagtggggagctggggagggagtagtggactctgcttcattgtccccagtctgcacaccccctcccccaccaccccactgcatttcccagctcagccaaactttctgannaagacgggcagagnnctgctgggagatgggatcctgggccctgacttggctccatccagcagaggctgggaccagggtgcctttctgcagctgggaaaaatcagatgggcgctctta

SEQ ID NO: 251 - DNA, 303 bp, Homo sapiens
  CDS 108..302
  sig_peptide 108..233: Von Heijne matrix score 6.19999980926514 seq LSVLSLVINFSWS/RK
  misc_feature 279: n=a, g, c or t Oligonucleotide
aaaagctgtgaggttgtaactcagttcagtagtatttataaatatttgttttccacttttgtgcatattatacaaatgatggatataaaatttgtttwgaccatwtaatgatgcttrmwwwrrraagaggatatcctcatagaactgaacgttatgatggatttttaaaatattctgacccaaatgatattgcattgtcagtactgtccctggttattaatttctcctggagtagaaaatgctttgttccttactatatcccatttaaaccttaccgvntaccttaccccaccgcggcccggg

SEQ ID NO: 252 - DNA, 259 bp, Homo sapiens
  CDS 106..258
  sig_peptide 106..222: Von Heijne matrix score 6.19999980926514 seq CFVCXLFVFLLSG/LN
  misc_feature 134: n=a, g, c or t Oligonucleotide
atttaaaaggattttttaaaggacctctatagttataagtcagcttaattaaaaatggatattccatagtcatatttatatatatatacacacacatatatatgtatgtatgtgtgtatatatatatrtttaanagacctgtatgatttttttcttcttggaacttatttttttgagagaaagtgttttgtgtgtktgttgtttgtttttcttctcagtggactgaattatttctccattctgtctttttacccccggg

SEQ ID NO: 253 - DNA, 165 bp, Homo sapiens
  CDS 14..163
  sig_peptide 14..133: Von Heijne matrix score 6.19999980926514 seq FITFIFSFSFCEC/IV
atattttatacacatgtgcatattctgcctttttcatttactatatcataaacttctttctagatcattatttttctgctgcattttttcaggatttatcacctttatttttagttttagtttttgtgagtgtatagtaggtatgtatatttatggggcacgaag

SEQ ID NO: 254 - DNA, 328 bp, Homo sapiens
  CDS 207..326
  sig_peptide 207..287: Von Heijne matrix score 6.19999980926514 seq LLIFLYLSLNLFC/IF
aaacgttttcttttatctaatttatattaaatttaattaaaataagccaggaggctagtggctaccatgttagcagcacagtcctatatattctttcacttttgttacatttgttatcaattttaactactattattattacatacaatacaattttaacaataggagattgctattagatgaggctttaacagaaaarvattaavatgaraatatgctataacatttttcaaaacattctcggcctcttgcttattttcctgtatctttctttgaatcttttttgtattttcttttctgtccctgcccttcaacctagaagactggg

SEQ ID NO: 255 - DNA, 320 bp, Homo sapiens
  CDS 233..319
  sig_peptide 233..310: Von Heijne matrix score 6.09999990463257 seq MLTLLGFPSKALT/FI
  misc_feature 129: n=a, g, c or t Oligonucleotide
caagttgtctcctgcgtagtgtctattagctcttgaatttcttcaagatccatatactgaaacacttcactctccaacttttttgccatattgacaatcactttcataatttcacttattgacyctgynwhaaatcmtgtgaagyhatgcagahcatctggacacagctttctccagcagggatyyatdgttttgggcttgaaggggtttcacggctttttctataacaacgatggcatcttcaatgctgwaatccttccagactttcatgatgttgactctattgggtttcccttccaaagctttgacattcatttcca

SEQ ID NO: 256 - DNA, 305 bp, Homo sapiens
  CDS 205..303
  sig_peptide 205..264: Von Heijne matrix score 6.09999990463257 seq LLSLPGSFIPGNC/RP
tttgttttatttggttatttgttttgttttgtttctctgaggccaatgggtgggaggaagtataaagaagtgtaaacaggaaagccagctgggcctggagttccaagtgcccatatttcatcagcttcctctccataactgtggcagggacacttaacccttccctggctgtgagaagttattctctgagggctggtgagcagaatgggaagatctaagaggcagctcctttccttgcctggttcctttatccctgggaattgcaggccaaggattctgagcaatggwgaagwcagaaggaaggg

SEQ ID NO: 257 - DNA, 181 bp, Homo sapiens
  CDS 37..180
  sig_peptide 37..111: Von Heijne matrix score 6.09999990463257 seq CFFLIFLLPPLPA/MI
tttctaatgctattatcctgmtagtgamtaagtctcatgagatctgatgggtttatcaggggtttctgcttctgcttcttcctaatttttctcctgccaccgcttcctgccatgatactgaggcctctgcagccatgtggaattataagtccaattaaacctctttttccttttttttttt

SEQ ID NO: 258 - DNA, 236 bp, Homo sapiens
  CDS 119..235
  sig_peptide 119..166: Von Heijne matrix score 6.09999990463257 seq LWTASSLPLSTHS/QR
caaaaaaatcagtctttaagcatttgcttggtaaggtttcttaagattaggtttataatacaaccatctgtaatgtatctstcgtttgagcttgtgggccatacaattcattaactagatgaatacattgtggacagcatcctcactacccctctctactcactcacaaagaaccatgatacactggaatgtttttctctggaattctttctactcttgtattaaaatttttcccc

SEQ ID NO: 259 - DNA, 265 bp, Homo sapiens
  CDS 128..265
  sig_peptide 128..220: Von Heijne matrix score 6.09999990463257 seq CLIGLLVPLLGWG/NQ
gacttaggatttgagcatctttctgttatgctgttgccccactcctattgcaatactccccttcttaagaaagtttttctagactaatgtctagattaaacttcttttctttgacaataatgatgccatgacttggacaaaatgcccattgcctctgggtcctgctttcttcacccagtgctgccttattggactccttgtgcctctccttggctggggaaatcagaatacacagtggtatcccacttctaagatgcctgatggg

SEQ ID NO: 260 - DNA, 272 bp, Homo sapiens
  CDS 162..272
  sig_peptide 162..257: Von Heijne matrix score 6.09999990463257 seq IVYFLVLLRVLYT/LQ
cacaaggttgatttaaaattcttaaaaaatttttcaaaatctttccaaatgaaacaagatttattgttaatctacagaaatatcctccattcactttgatatttaaatgacatcgtacattttaggtagagcatttttatgaccactcattgcttagtctgatggggaggagcaatgattttaggtttgcctttctaacatgctttcttggatgggaaatagtatatttcttggtgcttcttcgtgttttatacactttacaatggggtggg

SEQ ID NO: 261 - DNA, 98 bp, Homo sapiens
  CDS 26..97
  sig_peptide 26..79: Von Heijne matrix score 6.09999990463257 seq LTSFLTYMPLISS/SC
tttctaggtatacaatcatattataatgaaaacagataatttgacttcttttcttacatatatgcctcttatttcttcctcttgctcaattgctccct

SEQ ID NO: 262 - DNA, 419 bp, Homo sapiens
  CDS 28..417
  sig_peptide 28..264: Von Heijne matrix score 6.09999990463257 seq ATVAVLSFILSSA/AK
attcccgggccctggcttcttggcgcgatgaggttccggttctgtggtgatctggactgtcccgactgggtcctggcagaaatcagcacgctggccaagatgtcctctgtgaagttgcggctgctctgcagccaggtactaaaggagctgctgggacaggggattgattatgagaagatcctgaagctcacggctgacgccaagtttgagtcaggcgatgtgaaggccacagtggcagtgctgagtttcatcctctccagtgcggccaagcacagtgtcgatggcgaatccttgtccagtgaactgcagcagctggggctgcccaaagagcacgcggccagcctgtgccgctgttatgaggagaagcaaagccccttgcagaagcacttgcgggtctgcagcctacgcatgaataggtt

SEQ ID NO: 263 - DNA, 371 bp, Homo sapiens
  CDS 133..369
  sig_peptide 133..174: Von Heijne matrix score 6.09999990463257 seq FLAALFTVAKIWK/QP
cactatggagaactgtatggcgggtcctcaaaaaactaaaaatagaactcccatatgatccagcaatcccattgctaggtatatacccccccaaaaaaggaaatcagtatatgaaagagatatctgaatcccatgtttcttgcagcactgtttacagtagctaagatttggaagcaacctaagtgttcatcaacaaacaaatggacaaagaaaatgtggtacatatacacaatggagtactattcagccataaaaaaagatgatatcctgtcatttgcaacaatatggatggaactggagagcattacattaagtgaaataagtgggscaccaaaagacaaacttctcatgttctcactcatttgtggaag

SEQ ID NO: 264 - DNA, 283 bp, Homo sapiens
  CDS 194..283
  sig_peptide 194..274: Von Heijne matrix score 6.09999990463257 seq LSILQSLVPAAGA/XS
ctcattccctgtcctcggatcacagtctcttctcactacagtgtcgccgcctctgcctgcgtascccggccatggctctgtagcctcgacccctttgtgcccccggcccgtctccgcgctcaccacgcctgcgctctccgctcccaccttctttcttcagccgaggccgccgccgcctctccttgctgcagccatggagtcttccactttcgccttggtgcctgtcttcgcccacctgagcatcctccagagcctcgtgccagctgctggtgcagyctctcct

SEQ ID NO: 265 - DNA, 370 bp, Homo sapiens
  CDS 117..368
  sig_peptide 117..350: Von Heijne matrix score 6.09999990463257 seq LLWFLQTFFFGIA/SL
aaagcgcgctcccggggaggtgttgcagccatggctacggcagccggcgcgacctactttcagcgaggcagtctgttctggttcacagtcatcaccctcagctttggctactacacatgggttgtcttctggcctcagagtatcccttatcagaaccttgggcccctgggcccttcactcagtacttggtggaccaccatcacaccctcctgtgcaatgggtattggcttgcctggctgattcatgtgggagagtccttgtatgccatagtattgtgcaagcataaaggcatcacaagtggtcgggctcagctactctggttcctacagactttcttctttgggatagcgtctctcascatcttgattgc

SEQ ID NO: 266 - DNA, 274 bp, Homo sapiens
  CDS 178..273
  sig_peptide 178..225: Von Heijne matrix score 6.09999990463257 seq WIWVASILLRIFA/SV
tatcgtgaaagaatattgaattttatcaaatctttttttgtatctgttgagatgattacatggttattatccttcattctgttgatgtgatgtatcacatttattgatttgcatatgttgaaccctccttgcatccctggaatgattcctacttcattatagtgtataatctttttgatgtgctgttggatttgggttgctagtattttgttgagaatttttgcatctgtgttaatcagggatatttacctgtggttttctttttttttttttt

SEQ ID NO: 267 - DNA, 342 bp, Homo sapiens
  CDS 232..342
  sig_peptide 232..300: Von Heijne matrix score 6.09999990463257 seq LLFFXLWLRYKES/GR
  misc_feature 158: n=a, g, c or t Oligonucleotide
caagttatctcaatttcttctgagaagaaatatagtttcaaaatcaatcaataaagataatcctctgataaagtaagatctgaatatacaaatcatggttacagtaatcttaccattatatataaattacctctcaaacaaatgggccattcagaarnrggctcagagtgaattagctggaggggttgtcaagggtcatagtttttactgctttgaagagattatcactggatgatttcctcacatttatataacttcagtctcctgttctttktactctggctgaggtacaaggaatcaggaagagagggcaactgtgaggaaggagcattctccaggtgg

SEQ ID NO: 268 - DNA, 427 bp, Homo sapiens
  CDS 62..427
  sig_peptide 62..112: Von Heijne matrix score 6.09999990463257 seq RLLLLPRPPASTG/AS
agttgagtggaaatgggcaacggcgggcggagcggcctgcagcaggggaaggggaacgtggatggggtggcagcgactcctactgctgcctcggcctcctgccagtacaggtgcatcgaatgcaaccaggrrgccaaagagkttgtaccgagrctataaccacggtgtgctgaagataaccatctgtaaatcctgccagaaacctgtagacaaatatatcgagtatgatcctgttatcatcttgawkaatgctatattgtgcaaagctcadgcctacagrcatattcttttcaatactcaaataaataacaaactgcctattttattggcatttttaccttcctgtggvdgaacggcccatgacggcaaaaaaaagcccaacttcattttgctgctgaaasattattattatctagctacggaaaac

SEQ ID NO: 269 - DNA, 143 bp, Homo sapiens
  CDS 20..142
  sig_peptide 20..76: Von Heijne matrix score 6 seq LLALVVRVILSTA/IL
ctttctttgcggaatcaccatggcggctggggtaagtttgctggctctggtggttcgggtcatcctatccaccgccatcctttgcccgagtggggccagtcggcgccagaggagttctgaggttgagtggggaactgattcgg

SEQ ID NO: 270 - DNA, 79 bp, Homo sapiens
  CDS 23..79
  sig_peptide 23..67: Von Heijne matrix score 6 seq PLFWLILCSGLLC/NK
  misc_feature 2..3: n=a, g, c or t Oligonucleotide
tnngctaatcttgcttgtacttatgaatcctttattctggttgattctctgctctgggttattatgtaacaagtcattt

SEQ ID NO: 271 - DNA, 121 bp, Homo sapiens
  CDS 61..120
  sig_peptide 61..114: Von Heijne matrix score 6 seq ISIFLSSLSLSLS/LF
cttccttaagaagcggtttctctcccctcttttctctctctcacctgggtttgtttgtccatgagaggggcttggataagtatatttctttcttctctatctctctctctctctctttttt

SEQ ID NO: 272 - DNA, 292 bp, Homo sapiens
  CDS 196..291
  sig_peptide 196..267: Von Heijne matrix score 6 seq LFVLLPHFFLSFL/SP
ctcatggactgtggctgtcttattttatgtctctaataccagattatgaaaatcacagaaaaaaggaaaaaatattatttccaaagagtaagttatgaagccatgttagaaacccatatgacaatatgaatttcttttatctgtcaatctcaaggtagaattcctcatatttctgataatgccaaataccatgaaatgtctcaaaaaagacttgactttatataccagttgtttgtcttgctgcctcacttcttcctttcttttctttctcccttttatctgcacccatggg

SEQ ID NO: 273 - DNA, 158 bp, Homo sapiens
  CDS 2..157
  sig_peptide 2..100: Von Heijne matrix score 6 seq LAHFLIGLTVCFG/EG
catgtacctgtacctgttgtccatttgtatgtcttctttgaagaaatgtctattcaagttcttagcccactttttaatcgggttaacagtttgttttggtgagggrwggctaatgagttataggagttcttatttattacttaaaggaccaccggggg

SEQ ID NO: 274 - DNA, 113 bp, Homo sapiens
  CDS 31..111
  sig_peptide 31..96: Von Heijne matrix score 6 seq CLLVFLLTEWTSS/KL
cctttggtctttgatgatggtgacatacagatggggttttggtgtgaatgtcctttctgtttgttagttttccttctaacagagtggacctctagcaaactccaaaagacggg

SEQ ID NO: 275 - DNA, 254 bp, Homo sapiens
  CDS 182..253
  sig_peptide 182..247: Von Heijne matrix score 6 seq VLHLFPLTPASTG/HW
cccatctgcctgctcccactaggggtctgagtagcaggcaccgaagaagtgagccacgccctcttcacacaccctttgaggaggacaagggaacttttcctgtttcagaaagttgtgttgagaagaatggcaaggctaacagggcaggtgtccgggcggaggggcggaactggctgttggcatgtggtgggggagatgcttcatccgggtcttgcatttgttccctctgacaccagcctcgacaggacactggg

SEQ ID NO: 276 - DNA, 364 bp, Homo sapiens
  CDS 189..362
  sig_peptide 189..275: Von Heijne matrix score 6 seq LFMALPPVLSSHG/SR
acttgcacttgcttgttggtgtcagagcccgtccctaaaccagggctccatatgggctgcctgtctgccgcaacacagcctagcggggaaacagtagaaatgccacttctatgtatttatcatatttattttgagataattaacgaagacgttaaataaagccagactgcactgacccctggggcgccatgcgagaccccctcgcggacatggtacacagttatttatcatcgtctttgttcatggcccttccaccagtgctgagctcacatggcagcaggaacctgagaatctgggggagtccatttggtggagcgctgactaagggcaaagcacccccaaccccagcacaaccagccctggg

SEQ ID NO: 277 - DNA, 130 bp, Homo sapiens
  CDS 46..129
  sig_peptide 46..96: Von Heijne matrix score 6 seq WLCLPCSLCVSQL/LP
gtctttgcaggmvtgtttgtgctccaacagggagctgagtttgtcatgagcagtgcctggctgtgtctgccatgctccctgtgtgtgtcccagctccttccctcttattccctgttgatcccagccccgg

SEQ ID NO: 278 - DNA, 184 bp, Homo sapiens
  CDS 103..183
  sig_peptide 103..165: Von Heijne matrix score 5.90000009536743 seq LSLLGPLXPPMRA/CS
cattatgttgacatttctagctacaaggccagtattttacaaaataaggccttttcccttaattaaggttgtgacagataaaagtatattcccagctgactcatgtcacccatgtgggcaggcctattatccctacttggcccgctcwgtccgcctatgagggcttgctctgtgtgcgtactct

SEQ ID NO: 279 - DNA, 265 bp, Homo sapiens
  CDS 149..265
  sig_peptide 149..202: Von Heijne matrix score 5.90000009536743 seq LSIADLLPSSSFA/NP
tgagcatttcccaacatatctgttgagtttttaactctttttatgatcttttttatttctaggagttctatttggttcttttccaagtcagctatgtcatgttttaawagtttccwgtccttdgcrrtwctwttctawcttgaggtttatgtctttaaacgagttaagcatagctgatttattacccagctcatcctttgctaatcccaagctgagtgggccgatttctatctcggtcacttcagctggttctcctcccggggcg

SEQ ID NO: 280 - DNA, 188 bp, Homo sapiens
  CDS 110..187
  sig_peptide 110..154: Von Heijne matrix score 5.90000009536743 seq DLLGTAFLEGSLA/AY
taataataataataataaatttttctgttagattagtagatgttaagattatggacaaaatccaacgtagattggagtatagagaagtggacctttctgtgtggtcttgatgaaagacttacttggcactgcctttctggagggaagtttagcagcatatctcaccatggccaatataacccatgtgg

SEQ ID NO: 281 - DNA, 177 bp, Homo sapiens
  CDS 91..177
  sig_peptide 91..147: Von Heijne matrix score 5.90000009536743 seq HLFMCLLTICISS/LE
gccaacttgttttttgctgtagttttgattagagccattctactgggtgtgaagtgatattttgatgttgttttgatttgcatttccttgatggctaatgacattaagcatcttttcatgtgcttattgaccatatgtatatcttctttggagaaacttccattctttttttttttt

SEQ ID NO: 282 - DNA, 336 bp, Homo sapiens
  CDS 42..335
  sig_peptide 42..113: Von Heijne matrix score 5.90000009536743 seq ATLVGFTVGSVLG/QI
ttgcctattactcttatatctacagtgtggtggacctgggcatgtaccagaaagtcacaagttactgtcgaagtgccactttggtgggctttacagtgggctctgtcctagggcaaatccttgtctcagtggcaggctggtcgctgttcagcctgaatgtcatctctcttacctgtgtttcagtggcttttgctgtggcctggtttttacctatgccacagaagagcctcttctttcaccacattccttctacctgccagagagtgaatggcatcaaggtacaaaatggtggcattgttactgacacccagcttctaacaccttcctggctgggag

SEQ ID NO: 283 - DNA, 294 bp, Homo sapiens
  CDS 238..294
  sig_peptide 238..288: Von Heijne matrix score 5.90000009536743 seq ALFFLLRIAWLLG/LF
  misc_feature 227: n=a, g, c or t Oligonucleotide
acatacacgtcaattaatctgattcatcccataaacaaaactaaagataaaaaccatgtgattatctcaatatatgcagaaaaggctttcaataaaattcaaggcctctccatattaaaaactctaaaaaatctgggtattgaggaarcatagctcaaaagtgatgrgctgtttttgtaccagtatcatgctgttttggttactgtagccctgtagtatagtttgangttgggtaacatgatgcctccagctttgttctttttgctgaggattgcttggctattagggctcttt

SEQ ID NO: 284 - DNA, 203 bp, Homo sapiens
  CDS 90..203
  sig_peptide 90..152: Von Heijne matrix score 5.90000009536743 seq ALSLWASVSPSWM/CR
catctttcggcctagatggaggaaccgtgtgctggctgggcaggctgctggcagaggtcaggagggctcttccctgagccctgccatccatgaactgtgtaactttgatccaggccttgtccctctgggcctcagtttccccaagctggatgtgtcgtccccctgcttcattcataatcaccaccaccaccaccacctgcggg

SEQ ID NO: 285 - DNA, 297 bp, Homo sapiens
  CDS 240..296
  sig_peptide 240..287: Von Heijne matrix score 5.90000009536743 seq LLSLMARTDLVFC/SP
  misc_feature 107: n=a, g, c or t Oligonucleotide
aggcattgtctaggctgctgggcacatgagctccgggatgcccatgtcctctggccaggcagacacagacctggggcagcaccagctttctgatggcagcctgctcnttccaacagttccctaccagaatcctgcctcactggagcagaggatgccagcatcagccgggaaccactcctgtgctaaaaccgccttggtggcctgtggcttgaggtcttgatgcggatgaagccggaggaatgttgtctctcctcagtctcatggcaaggactgatcttgttttctgttccccacggg

SEQ ID NO: 286 - DNA, 774 bp, Homo sapiens
  CDS 8..772
  sig_peptide 8..109: Von Heijne matrix score 5.90000009536743 seq MAVLAPLIALVYS/VP
  misc_feature 486,565: n=a, g, c or t Oligonucleotide
agtcgttatggtgggggaggcggggcgagacctacgacgccggcgagcagtggccgttacggccgaaaagatggcggtcttggcacctctaattgctctcgtgtattcggtgccgcgactttcacgatggctcgcccaaccttactaccttctgtcggccctgctctctgctgccttcctactcgtgaggaaactgccgccgctctgccacggtctgcccacccaacgcgaagacggtaacccgtgtgactttgactggagagaagtggagatcctgatgtttctcagtgccattgtgatgatgaagaaccgcagatccatcactgtggagcaacatataggcaacattttcatgtttagtaaagtggccaacacaattcttttcttccgcttggatattcgcatgggcctactttacatcacactctgcatagtgttcctgatgacgtgcaaaccccccctatatatgggccctgagtatatcangtacttcaatgataaaaccattgatgaggaactagaacgggacaagagggtcacttggattgtggagttctttgccaantggtctaatgactgccaatcatttgcccctatctatgctgacctctcccttaaatacaactgtacagggctaaattttgggaaggtggatgttggacgctatactgatgttagtacgcggtacaaagtgagcacatcacccctcaccaagcaactccctaccctgatcctgttccaaggtggcaaggaggcaatgcggcggccacagat

SEQ ID NO: 287 - DNA, 614 bp, Homo sapiens
  CDS 155..613
  sig_peptide 155..205: Von Heijne matrix score 5.80000019073486 seq LWLKLLAFGFAFL/DT
aaaaaccgaatctgacatcatcacctagcagttcatgcagctagcaagtggtttgttcttagggtaacagaggaggaaattgttcctcgtctgataagacaacagtggagaaaggacgcatgctgtttcttagggacacggctgacttccagatatgaccatgtatttgtggcttaaactcttggcatttggctttgcctttctggacacagaagtatttgtgacagggcaaagcccaacaccttcccccactggattgactacagcaaagatgcccagtgttccactttcaagtgaccccttacctactcacaccactgcattctcacccgcaagcacctttgaaagagaaaatgacttctcagagaccacaacttctcttagtccagacaatacttccacccaagtatccccggactctttggataatgctagtgcttttarkaccacaggtgtttcatcagtacagacgcctcascttcccacgcacgcagactcgcagacgccctctgctggaactgacacgcagacattcagcggctccgcgscaatgcaaaactcaaccctaccccaggcagcaatgctatctcagatgtcccaggagagaggagtac

SEQ ID NO: 288 - DNA, 251 bp, Homo sapiens
  CDS 124..249
  sig_peptide 124..174: Von Heijne matrix score 5.80000019073486 seq LWLKLLAFGFAFL/DT
atttttatttacttttacatttttgattcgtttttacagagaaaaacttctacagagataacaattattttgcttttcagaaggacgcatgctgtttcttagggacacggctgacttccagatatgaccatgtatttgtggcttaaactcttggcatttggctttgcctttctggacacagaagtatttgtgacagggcaaagcccaacaccttcccccactggtgtttcatcagtacagacgccccaggg

SEQ ID NO: 289 - DNA, 416 bp, Homo sapiens
  CDS 155..415
  sig_peptide 155..205: Von Heijne matrix score 5.80000019073486 seq LWLKLLAFGFAFL/DT
aaaaaccgaatctgacatcatcacctagcagttcatgcagctagcaagtggtttgttcttagggtaacagaggaggaaattgttcctcgtctgataagacaacagtggagaaaggacgcatgctgtttcttagggacacggctgacttccagatatgaccatgtatttgtggcttaaactcttggcatttggctttgcctttctggacacagaagtatttgtgacagggcaaagcccaacaccttcccccactggtgtttcatcagtacagacgcctcaccttcccacgcacgcagactcgcagacgccctctgctggaactgacacgcagacattcagcggctccgcgscaatgcaaaactcaaccctaccccaggcagcaatgctatctcagatgtcccaggagagaggagtac

SEQ ID NO: 290 - DNA, 309 bp, Homo sapiens
  CDS 183..308
  sig_peptide 183..290: Von Heijne matrix score 5.80000019073486 seq LFLLSGTIWIAIC/KP
gaggccttttggtcacttagaagaggtgccaaagatcaaggagaggaaagtggtgggctacaaatgtaaattctgtgtggaagtgcacccaacgctccgagccatctgcaatcacctccgwwagcacgtccagtatggcaatgtcccagctgtgtcagctgctgtgaaggggctgcgttctcatgagaggagccacctggccctggccatgtttacccgcgaggacaagtacagctgccagtattgctcgtttgtttctgctttcaggcacaatttggatcgccatatgcaaacccaccacgaacgggg

SEQ ID NO: 291 - DNA, 359 bp, Homo sapiens
  CDS 142..357
  sig_peptide 142..333: Von Heijne matrix score 5.80000019073486 seq SALLRSLLLPXLX/QI
  misc_feature 282..283: n=a, g, c or t Oligonucleotide
caagtccacagcgctgggtgcagtacctccggcttcttcaggagtccatctggcctggtggagttttgcctaagtttccacggcccsgtaaggacccaagagcagaaactggctgctgagaaacaggctttgcagagcctgatgggagtcctcccagatctcgtagtagaaatttttggggtgaacaaatgccggctgagctggggtctagtcctggagtcactacaacaacccctcatcaacaggcatttgatttactgccttggggacatcatcctggrnntcttggatctcagtgctctgttgaggagtctgctgctaccasctctgsctcagataccccaggcaactctaagagg

SEQ ID NO: 292 - DNA, 254 bp, Homo sapiens
  CDS 129..254
  sig_peptide 129..173: Von Heijne matrix score 5.80000019073486 seq ALGFVLLAPRGWG/SL
gtttttcagctcgccattcacttcgctgtgaagatggcgtcgggcagcgggacaaaaaacttggactttcgccgaaagtgggatgtgggaaggtgggcagggaccagatcaaaggagacagccaggagatgacagcactggggtttgttctgttagctccacgtggctgggggagcctcacagtcatggtggaaggcaaggaagagcaagtcacgtcttacacggatggcagcaggcaaagagacagcaatttt

SEQ ID NO: 293 - DNA, 414 bp, Homo sapiens
  CDS 221..412
  sig_peptide 221..337: Von Heijne matrix score 5.80000019073486 seq LISFLHTLQVVCS/VI
gtcagagcacatccggtgttagaagcgctggtaggccttggagaggcgggttaggaagagtggagactgctgcacggactctggaaccatgaacatatttgatcgaaagatcaactttgatgcgcttttaaaattttctcatataaccccgtcaacgcagcagsrcctgaagaagatttcattactgtcttcagaaaactcatgatgatcctggccatgaatgaaaaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaactgat

SEQ ID NO: 294 - DNA, 334 bp, Homo sapiens
  CDS 156..332
  sig_peptide 156..221: Von Heijne matrix score 5.80000019073486 seq XVXLFXXVXVXXA/AL
catgtgtttctcatctttcaaccaccaaacttacataaaattcatccaccttcccattcttcctattatagtacaggaaaggtccttcctgtcaaaggcaaaatcacttatgattgtgtccccatctctcttgccttttcaaggactttgagcctatgctgccactgcttcattgtttttttttkgttkgtttgtttkgtttkgttttkgtttwaamagcagctttattgagatataatycaagtatacagkgtggccgggcacagkggctcamacctgwaatcccagmactttgggagactaaggmaggcagattacttgagcctaggaattt

SEQ ID NO: 295 - DNA, 375 bp, Homo sapiens
  CDS 284..373
  sig_peptide 284..346: Von Heijne matrix score 5.80000019073486 seq EMCLSQLFLQVEA/AY
ataacgctacctgccgagcaagccgagtggagggaggcaaaggccaggctgaggatcagggtggcccgggtggcagcggggaggcgctgcatgctggaggctgtgctgagtgcccggtgcaggtgagccggtcctgcggagttgtgccgagtgcctgctgcagtctcatttccagttcctccatgacgtggcaagtgaagacaggaatgaaaggratgtaaagcagcttttctctgaagagaagaagagagagagacacagccaagaccgaggctgggccaagatggtgtctgtgtttcgaagcgaggagatgtgtttgtcacaactgtttctccaggtggaagctgcatattgctgtgtggctgagctcggaga

SEQ ID NO: 296 - DNA, 226 bp, Homo sapiens
  CDS 104..226
  sig_peptide 104..187: Von Heijne matrix score 5.80000019073486 seq WWSVASLLSDVAA/WW
tggattgaaataaattcctagctccacggtcaggtcagtaggctgccatgatgaaatttgaagaagagtctgttatgatgtgtaataccaatttctggagggcatggctgctctccgaagtactctaacatggacagaagtcgtgggctggtggagtgttgcgtcgctgcttagtgatgtggcagcatggtggccaccgcactccacctcaacacggggaggggta

SEQ ID NO: 297 - DNA, 232 bp, Homo sapiens
  CDS 90..230
  sig_peptide 90..221: Von Heijne matrix score 5.80000019073486 seq LVCVFTCSLLAFF/SP
ctgaactttttatttttctatttttataaccaggagaaagtaaacacatacacacacatggatggagagagggacagagggatggacggatgaatgcattrgtagatgggaaacggcttasakrgtgcatacgctatttcgattctatctcactatattctaaggcaagtttaagttgttgtttagtgtgtgtgtttacttgttcattgctagctttcttcagcccatgcac

SEQ ID NO: 298 - DNA, 258 bp, Homo sapiens
  CDS 7..258
  sig_peptide 7..63: Von Heijne matrix score 5.80000019073486 seq WVFLVAILKGVQC/EL
ccaaccatggagtttgggcttagctgggttttccttgttgctattttgaaaggtgtccaatgtgaactgcaggtggtggagtctgggggaggcttggtacagccagggcggtccctcagactctcctgtcgaacttctggattcgcctttgatgattataatttgagttgggtccgccaggctccagggaaggggctggagtgggtaggtttcattagaagcaaaccttatggtgagacaacaacgtacgccgcgtgg

SEQ ID NO: 299 - DNA, 139 bp, Homo sapiens
  CDS 83..139
  sig_peptide 83..124: Von Heijne matrix score 5.80000019073486 seq SLFXLXXLRQSFT/XX
tttgggagctccagtgttaggcgcatatatatttyagaattgtgacaatttcctgttggtttagtcctyttatcattatataatgtccctctttgwccttyytyytttgagacagagtttcactchtgwtgcccaggca

SEQ ID NO: 300 - DNA, 286 bp, Homo sapiens
  CDS 196..285
  sig_peptide 196..252: Von Heijne matrix score 5.80000019073486 seq SFYFLASSSLSTS/AS
  misc_feature 16,286: n=a, g, c or t Oligonucleotide
asatcgcgctgggganasgccacgtcgctatgagtgtgtttcagtctacctggattaaacgtttgcttctcttcgtctaccttgattaaacgtgcacttcgcagtcctcggttctccatacccgtgacctggggatcgctacggaccttaaaatacccgcaacasccccttcgtsccaagctggagagcagtggcatgatctcggctcactgcagcttctacttcctggcctcaagcagtctttccacctcagcstctsaacgcactggaattacagatgtgagcn

SEQ ID NO: 301 - DNA, 242 bp, Homo sapiens
  CDS 113..241
  sig_peptide 113..184: Von Heijne matrix score 5.69999980926514 seq CLFVFLYTTPCNC/FG
tgcaatgggtggtgttttataatgctctcttccctaatcatgttaatcaggagattttccttttggaactcctgactgaaagcttcttagtttacacacatgttcctccaggatgaacgctgaaaataactttttcggttttgtttgtttgtttgttttcctctatacaaccccttgcaattgctttggtttagaacacctttggattctaagtttcatggttgttctgggagwyaccaggg

SEQ ID NO: 302 - DNA, 136 bp, Homo sapiens
  CDS 42..134
  sig_peptide 42..110: Von Heijne matrix score 5.69999980926514 seq LPCCCHLLTCVSS/LR
agtcacagtgacacagccttccaaccaggccgccccctggcatgaccatggctgtgggtgcagctgmycamctcccctgctgctgccatttrctcacctgcgtmtccagccttcgcamtgacatttacccacatgg

SEQ ID NO: 303 - DNA, 175 bp, Homo sapiens
  CDS 73..174
  sig_peptide 73..147: Von Heijne matrix score 5.69999980926514 seq SILLAALSRNISP/GQ
aagaggaagcggaakdgcctcaggtgggcggtagtgccaaaagcccagggcgtccgcgcaaaccgaggcgtcatgcggagaaaaaggcgagaaagaaaagagaggaagagcatcctcctggccgccctttcgaggaacataagtcctggtcagacataccgaacatcccccgcgg

SEQ ID NO: 304 - DNA, 493 bp, Homo sapiens
  CDS 402..491
  sig_peptide 402..470: Von Heijne matrix score 5.69999980926514 seq LELLTSSDPPSLA/SQ
ttaggtgttctgatagttaagtggtagtatcatggtcttaatttttccttgaagtggcttttgatttgcatttccttaatgactaattaggttgagcatcttttcatgtacttactggccttctttggagaaataccttttccaaatccaatgggttgtctttttttattgttgatcttaagggttcttaggtgttctgggtaccagtttcttgtgagatgtgtgacttgtaaatactttcttccattctccatgttgtctttttattctcttgatggtattctttgaaatacaaaartktttatatttgacaaagttcagtttatttatttatttattgccattcgtgcttttggttttgataatccatttttwttgtttttatttttatttacttagagatggggtctccctatgttgcccacgttggtcttgaactcttgacctcaagtgatcctccctccttggcctcccaagtgctgggaatacattm

SEQ ID NO: 305 - DNA, 214 bp, Homo sapiens
  CDS 79..213
  sig_peptide 79..135: Von Heijne matrix score 5.69999980926514 seq VCWLTLTLAHSHS/LT
cacacacgcaccaaatacacacagasaccctggccctcactcacgcacavtctctcacactcgtggacacacccccagatgcatctttacactcatgtatgctggctcactctcacactggcacactcacacagcttgacccacacgcacacactcacacccagtcacacacgtacacactcacatacgtgtgcttgcctacacgcacacaagg

SEQ ID NO: 306 - DNA, 458 bp, Homo sapiens
  CDS 306..458
  sig_peptide 306..350: Von Heijne matrix score 5.69999980926514 seq LSLTFYHFPLCWG/HQ
  misc_feature 286,448: n=a, g, c or t Oligonucleotide
atcagagagcgccggaagcggtccgagaatgaagcagtgtgatctaccatgcattgtctcagaaagaggcgaatgactccgatgtccaggtcagttcttggcagggagtccaggagcaacagaggtgatggcaaagatggctcagtagcttctgagcccccagcactgattgagatgtcctttcccacatcatactcctcatttttctggcagacatctaaggctggatcaaagtctgtagttctcattacctgttcccacgtgccagcctccttttctgttgtgnmmaagtcaagtttggtaaaatgaggctttccttaaccttttatcatttcccactgtgttggggacaccaggctgtgcccacgtggtggsaargcatcattcaaccttgtcactgtgccctctgcacttctgcagaaggtgtgcaatcacatatcataagtgnaatttacaga

SEQ ID NO: 307 - DNA, 328 bp, Homo sapiens
  CDS 87..326
  sig_peptide 87..128: Von Heijne matrix score 5.69999980926514 seq NVLIIVFVAFAFG/FL
tatcttctctccagtctaaagcctcactgaacaaactgtccttgactgtcagtgctcagggaactgctctgccacccttctcctcaatgaatgtgttaatcattgtttttgttgcatttgcttttgggttcytggtcatgaagtctttgcttaagccaatgtcgagaagggtttttctgatgttatcttctaggatttttatggtttcaggtcttagatttaagtccttgatccatcttgagttgatttttgtatataagttgagagatgaggatccagtttcattcttctacatgtggcttgccaattatcccagcaccatttgttg

SEQ ID NO: 308 - DNA, 380 bp, Homo sapiens
  CDS 33..380
  sig_peptide 33..92: Von Heijne matrix score 5.69999980926514 seq LAWALPSLLRLGA/AQ
  misc_feature 326: n=a, g, c or t Oligonucleotide
agcggtctcccggcccctgccgccctgccactatgtcccgccgctctatgctgcttgcctgggctctccccagcctccttcgactcggagcggctcaggagacagaagacccggcctgctgcagccccatagtgccccggaacgagtggaaggccctggcatcagagtgcgcccagcacctgagcctgcccttacgctatgtggtggtatcgcacacggcgggcagcagctgcaacaccsccgcctcgtgccagcagcaggcccggaatgtgcagcactaccacatgaagacactgggctggtgcgacgtgggctacaactkcctngattggagaagacgggctcgtatacragggccgtggmtggaacttcacgggtsc

SEQ ID NO: 309 - DNA, 284 bp, Homo sapiens
  CDS 228..284
  sig_peptide 228..269: Von Heijne matrix score 5.69999980926514 seq VFLFLMISVFAGC/QI
aaaagaagaaagctgaatcatactcgatgattattgatcatttgtatacagctcaagccctcaagtagcctgctgtaatatttactagttacaaagaaaagattcgttttgtcacagttacatgaaaggtgcttatatttgcaaatatggagacaaagttcatcttaaaagattaaaatgagaatctcctaaatgaagcatttggaatattgattagtataccagaaatggtttttctttttcttatgatcagcgtttttgccggttgtcaaatcccttccggg

SEQ ID NO: 310 - DNA, 357 bp, Homo sapiens
  CDS 243..356
  sig_peptide 243..305: Von Heijne matrix score 5.59999990463257 seq AGLELLASSNSSA/LP
ttgagatcacctgaggcaacatagtgaaaccctgtatctagaataaattagagaaagaaaaatagtctgggcatgatggtgtgcacctatagtctccagctabtcasgagcctgaggcaggaggwtcacttgagctkaggagttcaaggatgcagtsacctgtgattgcaccactgcattccagcttggacaacagagtgagaccctgtcttaaaatttaaattttktgtyttwtggtagagatggggtctcgccctgtttccgakgctggtctcgaactcctggcctcgagcaattcttctgccttgcccttccaatgttctgggattacaggcatgagccrccacaccctagcgg

SEQ ID NO: 311 - DNA, 470 bp, Homo sapiens
  CDS 413..469
  sig_peptide 413..451: Von Heijne matrix score 5.59999990463257 seq MLCHLSLVFLGXG/QF
  misc_feature 30: n=a, g, c or t Oligonucleotide
ccgttaacgggattctggaatttgttaggntaattgcttttcaatatcaagagatctggcaatcaaatttaataatatcaagcttgcttggtgagcatggatttataagatagaatggtttgtgggggrgartatagtkacgaaaaagrktattgtttcccataatgcctggtattgtattaagtactttgcatacagtagggcatttcattgtcccagtgatcctcctgcaaagtaggtacaattatcttcaatttacaaatgaggaaaccaagctctcttcaagctgataagatgctgaactgagatttgaaccaagtccctctgcccctaagagcccctacccctagctgctactatatgctgtacccatctaagctttgtgaaatarccttgttccactgcagagaagatgttgtgtcacctatctctagtatttcttggckttgggcagttctggagtcaaaatg

SEQ ID NO: 312 - DNA, 187 bp, Homo sapiens
  CDS 98..187
  sig_peptide 98..148: Von Heijne matrix score 5.59999990463257 seq FMCLFAICISSNA/KC
aagtttgtttttgttggtggtggtgatagtttcttatattctattccataaagtatgaaatggaggctccttgtgatttttaatttgcacttctgtaatgactaatcttttcatgtgcttgtttgccatctgtatatcttctaatgcgaagtgtctgtttagtctttttcctttttttattgagggg

SEQ ID NO: 313 - DNA, 237 bp, Homo sapiens
  CDS 93..236
  sig_peptide 93..173: Von Heijne matrix score 5.59999990463257 seq CVLFTLLVSTRSG/RS
  misc_feature 111: n=a, g, c or t Oligonucleotide
ttgcttaggattttctaaaagattacataaaatactgttgaaaagatgattgcatacaaaacataatctgttcattgttaaacgtatacgaaatgttgggatacatctggnaacaagacaaagtctttgctaattgtgttctatttacgctcttagtgtctacaagatccgggagatcgcgsgcgggttgtgcctggaggtggaggggaagatggtcagtaggacagaagggchggg

SEQ ID NO: 314 - DNA, 356 bp, Homo sapiens
  CDS 272..355
  sig_peptide 272..316: Von Heijne matrix score 5.59999990463257 seq LILSLQVCRPATL/DQ
  misc_feature 275..276: n=a, g, c or t Oligonucleotide
ggatttgctttctttttctccaaaaggggaggaaattgaaactgagtggcccacgatgggaagaggggaaagcccaggggtacaggaggcctctgggtgaaggcagaggctaacatggggttcggagcgaccttggccgttggcctgaccatctttgtgctgtctgtcgtcactatcatcatctgcttcacctgctcctgctgctgcctttacaagacgtgccgccgaccacgtccggttgtcaccaccaccacatccaccactgtggtgcatgnnccttatcctcagcctccaagtgtgccgcccagctaccctggaccaagctaccagggctaccacaccatgccgcctacggg

SEQ ID NO: 315 - DNA, 162 bp, Homo sapiens
  CDS 40..162
  sig_peptide 40..150: Von Heijne matrix score 5.59999990463257 seq VLMLSLPLPPTPQ/QA
tacatgtgcagaatgtgcagatttgtcacataggtgtgtatgtgccacaggcgttggctgcacctatcaacccgtcatctaggttttaagccccgcatccattacgtatttgtcttaatgctgtccctccccttgccccccaccccccaacaggccctcggg

SEQ ID NO: 316 - DNA, 404 bp, Homo sapiens
  CDS 297..404
  sig_peptide 297..353: Von Heijne matrix score 5.59999990463257 seq FVIFPAALLLCWG/GL
taagctgaaaaagaatataaaaattaaagagaaattgaaaatctaagtcttgcagtgagaatgaccagaaatcgtttccctctctggggggttcctgtttaatatgaaagtcctcttaacaagcgtggacagaggaagttttaggtttgatttgaacttcatgtacatgacatatttcatttttttttcttccctcacaaatttcaacccaggccacttgtttgcagagactgccaaaccttccattgctgcttccaagatactcctggaatctgagattaccttttatcctcttgatggaccatgttgttatttttgtcattttccctgcagctcttctgctttgctggggaggactcatccccctatgcatcatctaccccccgatagctgacacagttggg

SEQ ID NO: 317 - DNA, 450 bp, Homo sapiens
  CDS 359..448
  sig_peptide 359..433: Von Heijne matrix score 5.59999990463257 seq LIIILXFDIYSLA/FI
  misc_feature 323,410: n=a, g, c or t Oligonucleotide
tatgtcttttgaatttgtgatgtacatattaacagtagattaagttgaaataataaaatctgtattgtttatgatttatcagttatatgatgagtagaatatagtctattgtggscmagtgtgtatatataacataaacaatacattaacccaattttgtgtgaaaattattttgggacctagtagctttcttggtcacaacctttcaaacaaacaaattttttttaaattaattttttcccttaataaagaaaacaattcctcaatgtgtaatagcaaataccttttaacaggtcatatatcatcaatgctttctttgaaancgtactgatgcttacaagatgctttacgagtaaagatgcttacaaatcttttctttcaagtagctcatcctctgatcattattctgntgtttgatatctactccctagcatttatccatgacgtggg

SEQ ID NO: 318 - DNA, 395 bp, Homo sapiens
  CDS 313..393
  sig_peptide 313..354: Von Heijne matrix score 5.59999990463257 seq LFGLRGMLPLTQQ/AP
aatcgaaaacagcaaatcacacaactgttaaaaatattttvtgtttacaaagccaagccaaaattttatgttttcctccccaaactttgatataaacactaacattttttagcatgtataaacatcattattaaccagtgtcctattaaaactccttttctatgatagaatgtctgttrcttttaggtggataaggcctagatgattggcctctaccagcatcctcatctctgtccctgatgcccagcttcarcctcgctcctgyatgctggaccgcttcagtghagctctcagacttgctctgtgtctcacatgctytttggcttacgtggaatgctcccactcacccagcaagctcccattcctcatttaagatgtaaattgagtgtcacctc

SEQ ID NO: 319 - DNA, 257 bp, Homo sapiens
  CDS 20..256
  sig_peptide 20..82: Von Heijne matrix score 5.59999990463257 seq ACVYACVCASVSA/CV
catctgtgtgtgcgtgtgtatgcgtgtgtgtatgcgtctgtgtgcatgtgtgtatgcgtgtgtgtgcgcatcagtgtctgcatgtgtgtatrtgtgtgtatgtatgtstgtgcgcgcgcatctgtgtgtgtgcatgtgtgtatgtatgtgtgtgcatctctgtgtgtgcatgtgtgtatgtgtgtgtgcatctgtgtgtgtgtgcatgtgtgcatgcgtgtgtatgtgtgtgtgcgtgcgtgcatctgtgtgtgtgc

SEQ ID NO: 320 - DNA, 325 bp, Homo sapiens
  CDS 256..324
  sig_peptide 256..318: Von Heijne matrix score 5.59999990463257 seq LIANLVLFISIAA/LR
accacgcctcctccaagtcccagcgaacccgcgtgcaacctgtccctaaaaaagccaaagcagtcactctttacctcccactttccctcctcccagcctttggcaaccactaatctactttccgtgtatatggatttacctattcaggacatttcatatgtcctttggtgactggcttctttcactttgcacaatgtttttaaggttcattcctgtcatagtgtgtgtcagtacgaacccctccttaaccatctaatggttatcacctctaatagttatctcatagccaatcttgttttatttatatctatcgccgccctccggg

SEQ ID NO: 321 - DNA, 201 bp, Homo sapiens
  CDS 31..201
  sig_peptide 31..183: Von Heijne matrix score 5.5 seq LSLHASLVTKAFS/IN
catcacaagaacccagagtggaattctgggatggaagagctggacagaaagtggagagagaaggtcctcccagcggcaaagctaattaaaaggagaaacctgttttccacatgcactcctcaatatggyacacatgctgctttcttgtcattacatgcctcacttgtcaccaaagcattttcaatcaattcctgggagtgg

SEQ ID NO: 322 - DNA, 159 bp, Homo sapiens
  CDS 77..157
  sig_peptide 77..151: Von Heijne matrix score 5.5 seq PLLLCPLSSGSPC/PR
aacaaagggacagaatggtcccagggttccttcttcttccttccagttaagagctcagagtggaagtgggctggggatggtgtcgggggcccaagctcccagctcccaaaggcccctgcttctatgccctttgagctcaggtagcccctgcccccgggg

SEQ ID NO: 323 - DNA, 420 bp, Homo sapiens
  CDS 325..420
  sig_peptide 325..405: Von Heijne matrix score 5.5 seq SFLPSLLSSFLLS/LP
  misc_feature 117: n=a, g, c or t Oligonucleotide
catgcaggatagtaatacgttagaatcaaaaataaggttatacttagaaaatattgatttgcctttttgattttgcatgtgtataatctggctctgaaatcagtgacacgaagtgancttcgaaacaagcctgagcaatagaagtagatgtggaaataacttcggtttctcaaggcaaatactttgataggaacaaacaaccgtttagatatagaagatgtgatacattcctttaaaaagaatttgaccttatgtcattgtaggcacacctcatatttcaattattcatatagtttttcttgagcaattgctggtttaagaataatgtcatgtcttttgcgtgcttatatcatttggatatttccttccttccttccttccctcctttcttccttccttctttccctccccccttccggg

SEQ ID NO: 324 - DNA, 210 bp, Homo sapiens
  CDS 9..209
  sig_peptide 9..116: Von Heijne matrix score 5.5 seq LHFVYCFLCCAEA/FL
ctccttatatgtttcagttactgatcctttgtcagatgaatagtttgaaaatattttctcccattcttggatggtctcttcattttgtttattgtttcctttgctgtgcagaagcctttttacttgatatgatcccatttatgcaattttactttggttacctgtgcttgtggggtattactttaaaaatctttgcccagtccaattggg

SEQ ID NO: 325 - DNA, 192 bp, Homo sapiens
  CDS 31..192
  sig_peptide 31..174: Von Heijne matrix score 5.5 seq VCLRLHVLSAVQT/ER
aggctgctgcagttggcgmatgaggcgaccatggccttgctgggtaagcgctgtgacgtccccacmaacggctgcggacccgaccgcwggaamwacggcgwyaacccgcaaaracgagatcatcaccagcmtmgtgtctgccttagactccatgtgctcagcgctgtccaractgaacgccgaggtgatggg

SEQ ID NO: 326 - DNA, 181 bp, Homo sapiens
  CDS 71..181
  sig_peptide 71..166: Von Heijne matrix score 5.5 seq TLALLSSDSVATG/SV
aatttcgcggcctagtggggcgtacgggcctcttttgaaagcctgagttacgatgtattgagcgcgtcgtatgcggccagcactaaggtccttctggcactcctctggtggaccgcccccatcggccacacttgccctgctctccagtgattctgtagctactggctccgtagtctcgcgg

SEQ ID NO: 327 - DNA, 185 bp, Homo sapiens
  CDS 39..185
  sig_peptide 39..116: Von Heijne matrix score 5.5 seq LFSGWLVWWGSRS/SQ
  misc_feature 143,145,175: n=a, g, c or t Oligonucleotide
caaagacgcactacttagtacagagaggttttgaatacatgctctgtgcatgcaaggcacgtggggtgatgctgctgctgttctcagggtggttggtttggtggggcagtaggtcctcacagtwcctcagaatgcctgagagntnagtaagtggggagggtcgaagcgatcdvdngccacatggg

SEQ ID NO: 328 - DNA, 210 bp, Homo sapiens
  CDS 57..209
  sig_peptide 57..182: Von Heijne matrix score 5.5 seq SLILPTSPSPAHS/GS
gacttaggtsyaggcgactgcccagacaatgactggtcccgcataccgagcagagcatgatcagcagcagtctgagtggaagagtgcctgtgatcttagggaacctgatgggcgttggagcagcggttcgacgcatgggtttctctttaatccttccgacttccccaagcccagcgcactcaggttccgctccaagtgcgggaccccgcg

SEQ ID NO: 329 - DNA, 318 bp, Homo sapiens
  CDS 149..316
  sig_peptide 149..286: Von Heijne matrix score 5.5 seq ILLISTLFYSLLS/GS
acacttaacccatctgttttctctaatgcacgacagattcctttcagacaggacaactgtgatatttcagttcctgattgtaaatacctcctaagcctgaagcttctgttactagccattgtgrgcttcagtktcttcakyckgcaaaatgggcataatacarkctattcttgccacatcaagggattgttattcctttaaaaaaaaaccaataccaaagaagcctacaatgttggccttagccaaaattctgttgatttcaacgttgttttattcacttctatcggggagccatggaaaagraaatcaagacgtggg

SEQ ID NO: 330 - DNA, 223 bp, Homo sapiens
  CDS 135..221
  sig_peptide 135..203: Von Heijne matrix score 5.5 seq LPFVCLLLRNVYS/DL
aacagtgtgtgagagttccctttcctccacatcctcgccagcatctgttattgcctgtctttttgatacgagcctttttaacaggggtaagatgatatctcattgtagttttgatttgcattctctgatgatcaatgatgttgagcaccttttcatatgcctgtttgccatttgtatgtcttcttttgagaaatgtctattcagatcttttgcccaatcgggg

SEQ ID NO: 331 - DNA, 362 bp, Homo sapiens
  CDS 272..361
  sig_peptide 272..343: Von Heijne matrix score 5.5 seq LIVVLVCISLVII/DD
aatggacacctaggttgcttccatatctgagctattgtgaataatgctgcaatgaacatgggagtggagacatctcctaagcatactgatttcagttcctttgggtatatacccagaagtgggatcatgtggtaatcttgtttttacttttttgaggaacctccataccattatccatgatggctatagtaatttacattcataccagcagtgcacaagggtctccttttctgtatacacttgccaacacttgttatctttcatttttttgatgctagccattctaacaggtgggaggtggtatctcatagtggttttagtttgcatttccttggtgattattgatgatgatgagcacgggg

SEQ ID NO: 332 - DNA, 89 bp, Homo sapiens
  CDS 34..87
  sig_peptide 34..75: Von Heijne matrix score 5.5 seq LLPLGLKVLGLQA/RG
cccagaccggtcttgaactcctggcctcaactgatgctcctgcctctgggtctcaaagtgctgggattacaggcgagaggcaccacgct

SEQ ID NO: 333 - DNA, 399 bp, Homo sapiens
  CDS 255..398
  sig_peptide 255..338: Von Heijne matrix score 5.5 seq PTLLVMWLSPQMA/SS
ttcactgcaaggcggcggcaggagaggttgtggtgctagtttctctaagccatccagtgccatcctcgtcgctgcagcgacacacgctctcgccgccgccatgactgagcagatgacccttcgtggcaccctcaagggccacaacggctgggtaacccagatcgctactaccccgcagttcccggacatgatcctctccgcctctcgaggtacggactaagataagaccatcatcatgtggaaactgaccagggatgagaccaactatggaattccacagcgtgctctgcggggtcactcccactttgttagtgatgtggttatctcctcagatggccagttcgccctctcaggctcctgggatggaaccctgcgcctctgggatctcacaacgggcaa

SEQ ID NO: 334 - DNA, 188 bp, Homo sapiens
  CDS 33..188
  sig_peptide 33..131: Von Heijne matrix score 5.5 seq SLCLLTVAVLVLT/FK
aatgaagggtactagaacacctgcccatccatatgggaaaaaaaaaaatctggacccctagctcatatcccatgcccagtcataaacatgtatccctatgtcttctaacggttgcagttttagttcttacatttaagtctttaattcattttgagtdaatttttgcatatgagataggggtccagggg

SEQ ID NO: 335 - DNA, 115 bp, Homo sapiens
  CDS 23..115
  sig_peptide 23..94: Von Heijne matrix score 5.5 seq CPSLLSPISPSQA/CP
ccaatacacatcactcagtggcatgagccctgtcctctgcttccatcgctgctcctgtccctccctcctcagccccatctccccatcccaggcctgtcctgagcccctccttggg

SEQ ID NO: 336 - DNA, 300 bp, Homo sapiens
  CDS 197..298
  sig_peptide 197..268: Von Heijne matrix score 5.5 seq IMFVCMCVCVCVC/VY
catgcttgttgtaacgtgtcaaacaatacagaggtgtagggaaaatacctagtgccaccctccactccaaaaccccatgtcgccagagataaccatttattcagacagtgagtatctattaagtatctattgctaggctttggagatagcataatgaacaaaatggatgtgctctctgcccttgtgatttggacagatgcttcagttatctttttctgtgtttatattgattatgtttgtatgtatgtgcgtgtgtgtgtgtgtgtgtgtgtatcgactgttttcttcctcctccccggg

SEQ ID NO: 337 - DNA, 307 bp, Homo sapiens
  CDS 5..307
  sig_peptide 5..277: Von Heijne matrix score 5.5 seq RVLLGAGIPPVSS/AP
cacaatgaagtcgactgtttcgtcgagggaagtggccaccgttgataaaatgaaaagacgccatgcagaatactgtgcacagggtctccagagatttaaagcccaactttctcaagatacccttccccavcatccacatctggagawagagaaggggcttgaaggcttggaggaaaatgtgcctctaaagggagagaaacctggagaagggggtccagagtctcctaagaagagaagaagggtgcttctcggagcgggcatcccaccagtaagctcagctcccaggagacagagccagcaggcaaca

SEQ ID NO: 338 - DNA, 123 bp, Homo sapiens
  CDS 16..123
  sig_peptide 16..75: Von Heijne matrix score 5.5 seq VHLFFFFFXETGS/RS
ttaattaaactgtggatgcacaacagttgtagacctgtgcacctttttttctttttttttyctgagacaggttctcgttctaatycctggctggagtscagtggtgcgatcatagctaactcc

SEQ ID NO: 339 - DNA, 451 bp, Homo sapiens
  CDS 318..449
  sig_peptide 318..443: Von Heijne matrix score 5.40000009536743 seq TFRLYLSLPVSQA/GP
  misc_feature 310..311,394: n=a, g, c or t Oligonucleotide
gtcacaaaaggagcactaagagcctgctttactttcttcctcagttgagtcgtggggacagcttgaaggagccaacctcaattgcagagagcagccgtcaccccagctaccgctcagagcccagcttggaaccagagagcttccgttctcctacctttggcaaaagttttcacttcgatccactatccagtggctcacgctcctccagcctcaagtcagcccagggcacaggctttgagctgggccagttgcaatccattcgttcagagggcaccacctccacctcctaataagagcctggccaaccagnnacgcaaatggaagcctatcttaatgacagcttgctcacaccttcagacagccctgattttgagtcagtgcaggcagggcctgnagccagacccacctttaggctatacctctcccttcctgtcagccaggctggcccagc

SEQ ID NO: 340 - DNA, 304 bp, Homo sapiens
  CDS 94..303
  sig_peptide 94..135: Von Heijne matrix score 5.40000009536743 seq PALGPALLQGSLX/RV
  misc_feature 244..245: n=a, g, c or t Oligonucleotide
gcgcaggggagaaacaaggcgccttggagttcaggtgactcccacacgggtcatgctgttgtctcctgatccagccggccctgccaggtgaccatgcctgctctgggcccagctcttctccagggctctctgkgccgvgtgggtcctcaccctccagcsccttccaccaactgcattcactcccaatggcacgtatctgcagcacskggcaagggaccccacctcaggcaccctctrsctgggnnstaccaacttcctgttccagctgagccctgggctgcagctggaggccacagtgtccacc

SEQ ID NO: 341 - DNA, 379 bp, Homo sapiens
  CDS 315..377
  sig_peptide 315..371: Von Heijne matrix score 5.40000009536743 seq LCCSGCVPSLCCS/SY
gtagccgccgccgaaacttccgccgccgcgtccgccgcctccggaactaaacggggtgaggtcacattcggttatctctaacgttggaaaacgatggagctaacacccattatggagattaamcvacttttcatcaggtttttaacttaagtcgtgaggaatacaacggtgaacacaagattcattttattttcatcaccatgggacgtatcctgttgttgagttctctgggtcagacctctgaagacttctcagatggatcctagtctcwrrgcttgccctgaaattactcgctgctcagggagagagttgaaatggttggcatcctcccactctgttgctccggctgtgtcccctcgctctgttgttccagctatgt

SEQ ID NO: 342 - DNA, 289 bp, Homo sapiens
  CDS 223..288
  sig_peptide 223..264: Von Heijne matrix score 5.40000009536743 seq AHSILLLASQAGC/LR
gggacccttttagctatgaaatattttggattgcgtagggtcttgcgcagcgcgaaaagtagcgtgggccaggacagcgggaggtaagtcgccaagaaaagggttgggaaragctcagaatcggacggctaggaagaaatgaccaaaaggagcctgatagccccctattctgcacgctgttcctggaaaccgcctttgcaaagacagtgagagaaatctaacatggctcactccatcttgcttctagcctcgcaggccggctgtcttcgctcattcctgggcaattggg

SEQ ID NO: 343 - DNA, 169 bp, Homo sapiens
  CDS 78..167
  sig_peptide 78..137: Von Heijne matrix score 5.40000009536743 seq WVFLVAIFKGVHC/EG
agctctgggagaggagcccccgccctgggattcccaggtgttttcatttggtgatcagcactgaacacagaagagtcatgacggagtttgggctgagctgggttttccttgttgctatttttaaaggtgtccactgtgaaggtcmaattggtggagtcgggggggcggg

SEQ ID NO: 344 - DNA, 112 bp, Homo sapiens
  CDS 63..110
  sig_peptide 63..104: Von Heijne matrix score 5.40000009536743 seq NTVFLLLFFGCFF/FE
tgtgttttctctgtcccaaattaaatgcattggggaagtttataattacaggaattccacgcatgaacactgtttttttgttgttgttttttggttgttttttttttgagac

SEQ ID NO: 345 - DNA, 349 bp, Homo sapiens
  CDS 207..347
  sig_peptide 207..278: Von Heijne matrix score 5.40000009536743 seq SCCCLSSSSFIAG/RR
tcatcgtctacgtggacggcagctggagcccgtggagcaagtggtcggcctgtgggctggactgcacccactggcggaccgtgagtgctctgacccagcaccccgcaacggaggggaggagtgccagggcactgacctggacacccgcaactgtaccagtgacctctgtgtacacactgcttctggccctgaggacgtggccctctatgtgggcctcatcgccgtggccgtctgcbtggtcctgctgctgcttgtcctcatcctcgtttattgccggaagaaggaggggctggactcagatgtggctgactcgtccattctcacctcaggcttccagcccgtcagcatc

SEQ ID NO: 346 - DNA, 191 bp, Homo sapiens
  CDS 45..191
  sig_peptide 45..143: Von Heijne matrix score 5.40000009536743 seq FMLIILSAILLNS/FI
ccttccataggtggtgtaccgttttgcattcccatcagcactgtatgacaatgcccatttcttcatattcccagaatgtgttgtcaaactttcacgatggctattttatgttaattatactttctgccattttactaaattcttttattggttgtgtcagcttttatcattgcttttcttggggttcaggg

SEQ ID NO: 347 - DNA, 229 bp, Homo sapiens
  CDS 144..227
  sig_peptide 144..203: Von Heijne matrix score 5.40000009536743 seq LSLVIFLLTVKHC/FR
tttcatatagccacctcctcttggtagccagaagacccttcggatgatgccccaggtgtaaaactctctggggcccgccccactcggaaggattactgaaatgagtcatttccgggacgccttttttactgttgaatgaaaggatgctaacacatggggcttccctgtctttagtcatatttctgttaacagtgaagcattgctttagatacagagtatacaagacttt

SEQ ID NO: 348 - DNA, 210 bp, Homo sapiens
  CDS 106..210
  sig_peptide 106..171: Von Heijne matrix score 5.40000009536743 seq FWTSIPILPLSSG/RQ
aaagaatccagttgagcctatcgggacttttgacctacagaactgtgagataaaaaatgggtgtcgttttagataacccatggcagcattccctcctctgctggaatgtcgtcagtggagactgactggggattctggacttccatccccatcctcccactcagcagtggtaggcagctccccctccccactagagaatggggaatgtgg

SEQ ID NO: 349 - DNA, 431 bp, Homo sapiens
  CDS 184..429
  sig_peptide 184..282: Von Heijne matrix score 5.40000009536743 seq LSAILSMLSLSFS/TT
  misc_feature 214: n=a, g, c or t Oligonucleotide
aggacatcctctccaatccaccacacaccaccttacccctctgctggcaagaggggacctgattcatcctcacgctaaacactcattctacccaactgattgagacagaacagaagataactgaaacttctctgccttcccgctgcaagaagtgaatgagcgatccctctcaactgactkraaatgtttgcctcacccaggagatggagctctncgaaggccttctctggccagcggacactcctatctgccatcctcagcatgctatcactcagcttctccacaacatccctgctcagcaactactggtttgtgggcacacagaaggtgcccaagcccctgtgcgagaaaggtctggcagccaagtgctttgacatgccagtgtccctggatggagataccaacacatccacccaggaggtggtammata

SEQ ID NO: 350 - DNA, 386 bp, Homo sapiens
  CDS 197..385
  sig_peptide 197..244: Von Heijne matrix score 5.40000009536743 seq HSVFLCAPALVFP/RP
aaagtaaagcggaggcagcgggggaagatggcggcggccgttccacagcgggcgtggaccgtggagcagctgcgcagtgagcagctgcccaagaaggacattatcaagtttctgcaggaacacggttcagattcggtaccagaggcgtaggggcggccgggctggtgcggctgagggacgcctcacccccctggagatgcccatacattccgtattcctctgtgcccccgccctcgtcttcccgcggccggtggcctggaaggcggagaggcccagcttgtgctttggtgcctcgctcccgcctctcgggcgttctctactggggcaggggagcagctttatttcttggggcacacaggctgcaattgtagagttakaacctcatt

SEQ ID NO: 351 - DNA, 307 bp, Homo sapiens
  CDS 68..307
  sig_peptide 68..253: Von Heijne matrix score 5.30000019073486 seq LACVFFLSHPLFX/XP
  misc_feature 279: n=a, g, c or t Oligonucleotide
ttttactctgtaattgttactaattgatttttgmatagggagcacattcccatggttcaaaattcaaatggtatacgatgaaaaatctctctcctgttcccataccccagccacccagttcctctcctgggatgcatccagtgtttacagtttcttatatatcctctcagcaagagttaatgtagacgtadgcagmtacattcgtgtgtacatacttgcctgtgtgtttttcctctcacaccccctttttaadsraccaaatggtagtgtatattgtcnmcgtcattctcccccttaccttttttgc

SEQ ID NO: 352 - DNA, 170 bp, Homo sapiens
  CDS 56..169
  sig_peptide 56..163: Von Heijne matrix score 5.30000019073486 seq VCLLIISLVLISG/LG
gttctttggtgatacaaacactgtattttgagtaatcttttccctatatttcgaaatgctgcctttatcacctactaaattcctaaatgtgttcttgggcctgttcctctattatcttcaattggtatgtctgcttattatttctttggttttgatatctgggttagggg

SEQ ID NO: 353 - DNA, 293 bp, Homo sapiens
  CDS 149..292
  sig_peptide 149..235: Von Heijne matrix score 5.30000019073486 seq LNQTLMLLREVLA/SH
tttctaatctsbtcaaattttatcaccatacaatcagtggtaktgttggaaatagtgcaactgcattattgactaccattgaagaaatgcatttgctaagcaaaaaaatattcttcaattagcttgaagtcttcatgcaagtaaattaatggacaaggttgaactcccaccacctgatcttggaccaagttctgcactaaatcagacactcatgttgctgcgtgaagttttagcatctcacgattcttcagtkgtaccattagatgctcgtcaagctgattttgtgcaggggg

SEQ ID NO: 354 - DNA, 331 bp, Homo sapiens
  CDS 148..330
  sig_peptide 148..243: Von Heijne matrix score 5.30000019073486 seq LVWLWFVVPQTIT/MI
  misc_feature 124: n=a, g, c or t Oligonucleotide
catttctagcttttgdkttaaagtgacagacttgccactcttcttttcccttgaacacttacaggctgtgggagggttattagttggtctaatttcaatamtgttcctttcyccagggaattgnraggcccaaggagagggagagagatggggggaacagctggttggagcagtcagaacacacacaacattkgagtacaccatcttgtgtggctgtggttcgtggtcccccaaacaattacaatgataacaccaaagatcactgaacacagaccastaataacagatatrdtrataatgayaacatttgaaawattgggagaattaccca

SEQ ID NO: 355 - DNA, 93 bp, Homo sapiens
  CDS 2..91
  sig_peptide 2..55: Von Heijne matrix score 5.30000019073486 seq ALYLCVCVCVCLI/AR
tatgtgtctvagtgtagctttgtatttatgtgtgtgtgtgtgtgtatgtctgattgcacgggtgtacttttgtatttatgtgtgtgtgtggtt

SEQ ID NO: 356 - DNA, 178 bp, Homo sapiens
  CDS 92..178
  sig_peptide 92..133: Von Heijne matrix score 5.30000019073486 seq LHLLFGLFPVLWM/FL
tgacccttgtccagtcttttccaggaaaaacatgccctcaagatgtttttctatcttgaggaaatgatggaaatgagatagttccaagggtatgcttcaccttctttttggcttatttcctgttctttggatgtttctagtgtatttctttctttcttcttttttttttttttttttt

SEQ ID NO: 357 - DNA, 107 bp, Homo sapiens
  CDS 40..105
  sig_peptide 40..93: Von Heijne matrix score 5.30000019073486 seq CVYLFCACMCVCA/FF
  misc_feature 54: n=a, g, c or t Oligonucleotide
tatatttatataaatatatataaatacacacatatatatatgtatgtgtgtatntgtgtgtatcttttttgtgcatgtatgtgtgtatgtgcttttttttttttttt

SEQ ID NO: 358 - DNA, 209 bp, Homo sapiens
  CDS 44..208
  sig_peptide 44..151: Von Heijne matrix score 5.30000019073486 seq FLFTLIGASLLQS/AS
ggggggcgacgtaagggcgctccgcgagcccgtctctcctcgaatgaaasgaaacaacctccggcgacagagccccgctctcaggcactgctggagamccgagaccgacttctttctctttaccctcattggcgcttctctcctgcagtccgcctctgggccctgccgcatttcttsasmcttaaagtggcattctaaaggcactttaa

SEQ ID NO: 359 - DNA, 298 bp, Homo sapiens
  CDS 135..296
  sig_peptide 135..194: Von Heijne matrix score 5.30000019073486 seq LGLGLPLLPPNHP/SV
agcatttgcmttcggagggccagargggcaggcagagcttaattccttgggcaaggctggggctgttggaatggggtctggaggccaggagccaccctgtctgggccagaaaggggcctkggtgcagggcaggcatgtggcccaagarggggctactgggattggggctcccactgctgccccctaaccatccctcggtagcccaagggacactcgtttcctcccactctggttctggctctgagggtagggtggcgctcaggagtgatgtccacagccccaagacaacccsccaacg

SEQ ID NO: 360 - DNA, 460 bp, Homo sapiens
  CDS 54..458
  sig_peptide 54..179: Von Heijne matrix score 5.30000019073486 seq AMAXLFLSAPPQA/EV
  misc_feature 150,285,328: n=a, g, c or t Oligonucleotide
gaggttgggctgccgtgctgctcggcggcgctgaggccaaatagttgcatcacatgtatctaatccgagagtctcatgcttctggtagctcctcagtgaccagctcctgctcactgmcctcagraagccccaaccctcaggcaatggcknccttgttcctgtctgccccaccccaggccgaggtgaccttcgaggacgtggctgtgtacctctcccgggaggaatggggccgcctgggccctgctcagaggggcbkctacagggacgtgatgctggagacctacnggaacbtagtctcactgggagtaggacctgcaggccccaagcntggagtgatctcgcagttggagcgaggggatgagccctgggtcctggatgttcagggcacctctgggaaagagcacctgaagaagtcaacagcccagctcttgggaccagaactgaagtacaaggagttgay

SEQ ID NO: 361 - DNA, 318 bp, Homo sapiens
  CDS 153..317
  sig_peptide 153..263: Von Heijne matrix score 5.30000019073486 seq ALSSLCVSWGTSS/TV
ctcttttccggttaacgcggcgtgagaagccatgagcagcaaagtctctcgcgacaccctgtacgaggcggtgcgggaagtcctgcacgggaaccagcgcaasgccgcaagttcctggagacggtggagttgcaggatcagcttgaagaactatgatccccagaaggacaagcgcttctcgggcaccgtcagtcccccaaaacgcaggcttaagtccactccccgccctaagttctctgtgtgtgtcctgggggaccagcagcactgtgacgaggctaaggccgtggatatcccccacatggacatcgagggcgcggg

SEQ ID NO: 362 - DNA, 360 bp, Homo sapiens
  CDS 192..359
  sig_peptide 192..233: Von Heijne matrix score 5.30000019073486 seq VCIFCFLTSKAFP/NP
  misc_feature 277: n=a, g, c or t Oligonucleotide
tattgggttgttttcttattatcaaattgtgaaagttctttacatattctgggtagaactcctttatcagatacatgttttgcaaatgttttctaccattctctgtctdhtctttctcttaatactttcacagtttttcatagcagaaatttataaattaatgaagcccactttatacttttatttcttttatggtttgcatcttttgtttcttaacttcgaaagcttttcctaaccctagatcacaggattttctcttagatttctctaggcattntataggtttaggtttcacatttaggtccgcaatgcattttgaaaacttccgtctgwaaggtttgggtcaagattccctttgtc

SEQ ID NO: 363 - DNA, 212 bp, Homo sapiens
  CDS 138..212
  sig_peptide 138..197: Von Heijne matrix score 5.30000019073486 seq GFCSVTSSPLASA/GR
  misc_feature 152: n=a, g, c or t Oligonucleotide
cacaaaatcaaaaackkagttgacgtatgccactttccagttactattgagatatatatgcgtgtgtgtatatattacatatatatgttatatatcatattkatatatttakaaawttatatmgavcatacatatatatgtawatrtatktnkktavagggttttgctctgtcacaagcagtcctcttgcctcagcaggtaggactacacgc

SEQ ID NO: 364 - DNA, 242 bp, Homo sapiens
  CDS 127..240
  sig_peptide 127..195: Von Heijne matrix score 5.30000019073486 seq LVPCPLLISVALS/VK
  misc_feature 71,73: n=a, g, c or t Oligonucleotide
actttaacttcctggagctctaatttctccttctcaggtagaagaatgccattcactcccaagtggtgagnmncaagcagccagtggtaggaagggtcatcaagtcagttgtcagaaacctcactkatgtcactgtwtahgctatgtgaccctgacctagttccttgccctctcttgatctcagttgctttatctgtaaaatttcacatttktcagcaagtcaaccttccatgttcctctca

SEQ ID NO: 365 - DNA, 248 bp, Homo sapiens
  CDS 7..246
  sig_peptide 7..123: Von Heijne matrix score 5.30000019073486 seq LXPCLTSFSCXGA/SF
tgtacaatgatgatccttatcctaattcttgagcatatcgtcacckccaaaagaaaccccaaacctgttacagtccctgcttttctgcscccttgcttgacttctttctcttgtkctggagcatctttctctctkttwggtgdgagaaggggttggcaacatggcagctgctgctccaccattcccttatttcsaactctaaattcccttgggcagggactcattggcccagcctacataggtgcdgg

SEQ ID NO: 366 - DNA, 351 bp, Homo sapiens
  CDS 293..349
  sig_peptide 293..340: Von Heijne matrix score 5.30000019073486 seq HAISILLCIGASS/QG
  misc_feature 36: n=a, g, c or t Oligonucleotide
aaaacatatatccacacaaaaacttgcacacataknttcatagcagcattattcatccaaaaagtagaggtactcaaatgactttcaactgataaacacagatgaacaaaatgtatgtccaaacagtagaatattattcagctataaaaaagaacagagtacacttagcaaactaagaatagaaggaacttcctcaatctgataaaggacatccatgaaaaacccaccactaatgtcatacttaatcatgaaaaaccgaatgcttttctcctaagataggaaaaagacaagtatgtctactcatgccatctctattctactttgtattggtgcttctagccagggcagggg

SEQ ID NO: 367 - DNA, 208 bp, Homo sapiens
  CDS 7..207
  sig_peptide 7..99: Von Heijne matrix score 5.19999980926514 seq ATVNAASLPPCFG/VK
gtctcgatggaggagcaagaaacggaagaggtcggggggagaagcagccggaaaaatgcagccaccgtcaacgccgcctccctgccaccgtgcttcggggtaaaaagctgccgttgccgtcggtgcagttgccgtcgctgcctcctatacttctcttggcctcggggaaggatttccccaccggtgggacaatgtgcggggaggggat

SEQ ID NO: 368 - DNA, 446 bp, Homo sapiens
  CDS 11..445
  sig_peptide 11..109: Von Heijne matrix score 5.19999980926514 seq CCCHAGASSGATA/WE
agaatccaagatgcgcgggatccargcaaargggtctccgggccagagttcggccgstgttctgwcgccttgctgctgtcacgcgggcgcttcgtccggggcgacggcgtgggaggagaccccgcggtcgcgttgccacatcgccgttkcgagtacaaatacagcttcaaggggccgcacctggtgcagagcgacgggaccgtgcccttctgggcccacgcggggagtaagccggagcagagggctgggggccgggttcctctcccccttctgctgcctcttcgcctttcatccgcggctaccctggtgtgctgaggttcccgttccagcagctgcacaccatatgcgctgtggaggggacctcctggcagcccctccgccgggtccctcctggttcgcacggttccctccgcttgtccccgagtctttccctcaccattctgttc

SEQ ID NO: 369 - DNA, 125 bp, Homo sapiens
  CDS 22..123
  sig_peptide 22..93: Von Heijne matrix score 5.19999980926514 seq LIWVFGLVSVLSX/FL
ctatcaagaggctttccccctatgttttcttctaggagttttatggtttcaggtcttatttgggtctttggtcttgtatctgttttgagtbgatttttgtgtatggtgtatgatcagggtcaggg

SEQ ID NO: 370 - DNA, 132 bp, Homo sapiens
  CDS 39..131
  sig_peptide 39..77: Von Heijne matrix score 5.19999980926514 seq MLLAVSLSLVSNC/NF
atcttagaggaaagtctttcagtttttccccattcagtatgttattagctgtgagcctgtcccttgtctctaattgtaactttgtactcactgaccaacttttccctgcccctgcstccctcatccccgaag

SEQ ID NO: 371 - DNA, 127 bp, Homo sapiens
  CDS 4..126
  sig_peptide 4..90: Von Heijne matrix score 5.19999980926514 seq TGVFLFSIIGSFG/FP
tgaatgaaccaagatttcaacccagaaattgaggcttcaccacaagtgaagactggggttttcttgttttcaattattgggagttttggatttccaggaatgtgcaattgtaaaaacccagcccggg

SEQ ID NO: 372 - DNA, 196 bp, Homo sapiens
  CDS 125..196
  sig_peptide 125..184: Von Heijne matrix score 5.19999980926514 seq IVSSLFSWLLSLT/SV
  misc_feature 119: n=a, g, c or t Oligonucleotide
taaaaatcttttatgttctacccactccttcctcgttccctctccccactcctccctccccccatcttaagcccatggcaacccctgatctttttactgtctccatcgttttgccttbnccagaatgccatgtagttggagtcatatagtaagtagccttttcagttggcttctttcacttaccagtgtgcccggg

SEQ ID NO: 373 - DNA, 148 bp, Homo sapiens
  CDS 56..148
  sig_peptide 56..139: Von Heijne matrix score 5.19999980926514 seq PVLSCCCLTAGRA/RL
actttcttcacacccaggacgcagggtgccgctgccggccacagaaaccccaagaatgtttttctttggctattcagaggacatctattgtgtgtcaggccctgtgctgagctgttgttgcctgacagcaggaagagcgcggctctgg

SEQ ID NO: 374 - DNA, 200 bp, Homo sapiens
  CDS 26..199
  sig_peptide 26..73: Von Heijne matrix score 5.19999980926514 seq AALICPWSSQVPS/SP
ctagggaggactcaatgctctttgtatgccttatgcagcgctgatctgtccctggagttcccaggttcccagctccccccctgcaagccttgaagcctccagcaacgtctatctccaggagagcagggcagcctatgcaagtgttccggcaggaccagaagtggccactcaacacacgtcctcaccagtcacccctatgg

SEQ ID NO: 375 - DNA, 112 bp, Homo sapiens
  CDS 52..111
  sig_peptide 52..105: Von Heijne matrix score 5.19999980926514 seq LTYSLAFLLFIKA/GT
aataaccctttcacagcacttgcctgtttttaatgaatctaattattcacaatgcaacttttatatttaacatactctttagctttcctgctatttatcaaggctggcaccg

SEQ ID NO: 376 - DNA, 146 bp, Homo sapiens
  CDS 74..145
  sig_peptide 74..133: Von Heijne matrix score 5.19999980926514 seq AAAVTSSAAPSRA/RQ
ggctggagcgcgcgcctcctagcggascggggcaattggaaggccgcgcctcaggaaaacaggatggtagtgaatggcaccgagccgccccagggctgccgccgtcacctcctcggcggctccgagtcgtgcgaggcagggggccc

SEQ ID NO: 377 - DNA, 389 bp, Homo sapiens
  CDS 218..388
  sig_peptide 218..343: Von Heijne matrix score 5.19999980926514 seq QHLLSWAXQXGRX/QV
  misc_feature 139: n=a, g, c or t Oligonucleotide
cattttgtcggtagaggcagaaggwgaaggtcgggttgtagaagctggggtggccggcagctcgctcatcggtgttcgtgggctttgtcggtccgtgcctcgtctctccctggaaagggagggaggcttcgacgtcgrnraggragmmgctgccgcgttagttccgagcttgaagtcactaggacttctctcaaacttgtgtgctgaggagactcagatgttggcctcagctcctaggctgaactcagcagatcggcccatgaaaacttctgtattgagacaaaggaagggatctgtcagaaagcaacacttgttatcttgggcttdgcagyaagghagakgacaggtagtggagatcctgcaatctgaaaagcagactdaargtgacg

SEQ ID NO: 378 - DNA, 143 bp, Homo sapiens
  CDS 2..142
  sig_peptide 2..115: Von Heijne matrix score 5.19999980926514 seq LHGSLDAVSQAQG/RP
aatgtaccccctaggcaggggagagcagggccctgctgcacccaagtcctggttgctcctccccaccacactggccctccatggaagccttgatgcagtgagccaggcccaaggacgccccggccaccctgacgcacccccca

SEQ ID NO: 379 - DNA, 261 bp, Homo sapiens
  CDS 198..260
  sig_peptide 198..245: Von Heijne matrix score 5.19999980926514 seq FIAALFTIAETWN/QP
cagatggtggtgaggttgtagagaaaaaggaacgcttatacactgttggtgcgagtgtaaattagtttaaccattgtggaagatgatatggcaattccacaaagacctaaagtcagraattmcmattcaacccagtaatcccattactgggtatatactcaaaggaatataaattgttgtgttacaaagacacatgcatgcgtgtgttcattgcagcactgttcacaatagcagagacatggaatcaacccaaatgcccag

SEQ ID NO: 380 - DNA, 228 bp, Homo sapiens
  CDS 63..227
  sig_peptide 63..152: Von Heijne matrix score 5.19999980926514 seq LCFLSVHFRLRWG/DS
gggacgtgggaaaatgactacgcgtcactcgtgatgtcgcgcatccgataggcccttttcagatggcaaaaggcctgagggtgaatctgggcgagctggttgagtccatgcgtttgtgcttcctctcagtccactttcgcttacgatggggcgactcttgtccatcgtcacctcaccgggaaacttttcctgccgggccagttaatggtcccctgtaccacccccggg

SEQ ID NO: 381 - DNA, 300 bp, Homo sapiens
  CDS 39..299
  sig_peptide 39..89: Von Heijne matrix score 5.09999990463257 seq QLLVLFGSQTGTA/QD
agtttttagtctcagaccagaccaccgggcgcgccccgatgccgagcccgcagcttctggtgctcttcggcagccagacaggcacggctcaggatgtgtcggagagactgggtcgcgaggcccggggccggcggcttggctgccgggtgcaggccctggactcctacccggtggtgaatctgattaacgagcccctggtgatatttgtttgtgcaactaywggccaaggagacccccctgacaacatgaagaacttctggaggtttatattccggaagaacctgccctccaccgcccggg

SEQ ID NO: 382 - DNA, 151 bp, Homo sapiens
  CDS 8..151
  sig_peptide 8..130: Von Heijne matrix score 5.09999990463257 seq SFLFLACIFQGXS/XX
atacataatgtcttccattttgggtgtctcatcctcatggtggtatttatattatggctattgtatatttgttaaaaagtgctctttttgcagtttcctgttccttgcctgtatttttcaaggctkttckcktkatwcaaacacacaaagc

SEQ ID NO: 383 - DNA, 255 bp, Homo sapiens
  CDS 101..253
  sig_peptide 101..184: Von Heijne matrix score 5.09999990463257 seq CLCGSAPCLLCRC/CP
gcgtccggaagtgtctcgcagatagtaaataatctcggaaaggcgagaaagaagctgtctccatcttgtctgtatccgctgcwcttgtgacgttgtggagatggggagcgtcctggggctgtgctccatggcgagctggataccatgtttgtgtggaagtgccccgtgtttgctatgccgatgctgtcctagtggaaacaactccactgtaactagattgatctatgcacttttcttgcttgttggagtatgggg

SEQ ID NO: 384 - DNA, 456 bp, Homo sapiens
  CDS 128..454
  sig_peptide 128..265: Von Heijne matrix score 5.09999990463257 seq IGSCSVMSSGALC/VP
tacaactttgaaaagcccttcctctggcttgctagacagctcattggagaccgtaacttggaatttgttgccatgcctgctcttgcctcaccagagattgtcatggacccaaatttggcagtgtagtatgagcwkrwttagmaggttgsttagacaactgctctcccagrtgaggrwgatgacctgtgagaatgaagctggagcccagtgtcaraagtctagttttataggcagctgttctgtgatgtcaagtggtgcactgtgtgtgccactttattatctagctaagggcaacatgtgctccatctgtgggatgctgaaggagatgaatgggctttggagtgaatgtgacagtttaaaaaataccttcattgtttggrcctgcatatttagctgtttgggaatgcaattgawttcttctkgrgtttcaaatgtaagactgctactgtcacatca

SEQ ID NO: 385 - DNA, 193 bp, Homo sapiens
  CDS 1..192
  sig_peptide 1..78: Von Heijne matrix score 5.09999990463257 seq AFPFVCLTFCVGG/GP
atgcctcatccactggctacctctgcgtttctgcgttccgcctttccttttgtttgtctcacgttttgcgtgggaggcggtcccgggatttcaggggtctaccggctccttatggcgaatgcaacccgaagagagagtgaggtaagcctccgcgggttgggcagggacggagagggggcccgcgcgactccag

SEQ ID NO: 386 - DNA, 281 bp, Homo sapiens
  CDS 199..279
  sig_peptide 199..267: Von Heijne matrix score 5.09999990463257 seq SLMVFLNLFFLNC/DP
tgtttataggttttaactcttatggttagaatggttgtgagtcatacgwgtgtcagacctctgctaatttcctcaggacacattcccagaagtggaattaccaagtcaaagagcataaatactttagagatacatgataaattgtgccagctacctttccaaaagagttgtactagttgaggtttctgccagcagtatatgacagttgggctccatattttaagagattcactaatggtgtttctcaaccttttttttttaaactgtgacccacacagggg

SEQ ID NO: 387 - DNA, 111 bp, Homo sapiens
  CDS 5..109
  sig_peptide 5..67: Von Heijne matrix score 5.09999990463257 seq MFCVSLLLHHAYP/LP
caccatggtaagatggggacatccccctatgttctgtgtctctctcctgctccaccatgcttatcctttgccttccaccatgattgtaagtttcccaaggcctcccctggg

SEQ ID NO: 388 - DNA, 374 bp, Homo sapiens
  CDS 96..374
  sig_peptide 96..173: Von Heijne matrix score 5.09999990463257 seq AMVCFGCPGGASS/RC
  misc_feature 344: n=a, g, c or t Oligonucleotide
ttttggccgccatgttttcgtcgcagtaactgccttggtgtcagtagtcattgccagtttcgggcgttctggacaattgggatgctgcagagttcatggctggggctgctcgttgggtgggacaakaatcctctgcaatggtttgttttggctgcccaggaggtgcgtcaagtcgctgccgctcccctcgtgggcgtcaggcctcaagagttccccgcctagaaaatggagctcagcgagtcgtgcgtaccatggtgcacctggttttgcagcctaagcgggtcactttagtgcatcctcctcgcggattggagcctgtttgcacccctatagcmvgaatgarncccaagtcacacgggctcagaagttctttg

SEQ ID NO: 389 - DNA, 192 bp, Homo sapiens
  CDS 52..192
  sig_peptide 52..153: Von Heijne matrix score 5.09999990463257 seq PXLLSXLHGLLYG/SP
ggcagacttcaaccaggctgtgggaggagagctcagtggggcacagagaagatgggtgttgtcagtgggggtgttggtgacttgaccacaaaaacccaagagaatgggctcttaccagvcctyctctccwkcctkcacggactgctctatggcagccctgatgcagarctcacgggcccggatccctgggat

SEQ ID NO: 390 - DNA, 371 bp, Homo sapiens
  CDS 321..371
  sig_peptide 321..365: Von Heijne matrix score 5.09999990463257 seq FLSXTCVLSCXRS/LS
tctgttcaggttttgtatttgttcatagtataatcttggtttgtaggttgtgtgtatctgggaagaaactttacaatctctaacaggcctggaaggtctaatctataaaagtatttcattgaccttgaagaaggtcaattatttatataagaaaataaactcaacattttatccataaaaaatgtaattccggaatttatgttagtaaaattataacactgataacataaaaagtgctattaatccttaagaaagagttaccttttcttttctatcttcatcacagctagcccagtcttagtctatttcattagcttcctatgggcttcctctcacktacatgcgtgctctcttgcdtgcgctcgctctct

SEQ ID NO: 391 - DNA, 328 bp, Homo sapiens
  CDS 184..327
  sig_peptide 184..300: Von Heijne matrix score 5 seq LVCFFNSVSFLFG/VS
ccgttatgtgttcagctcaattagattaattaccttcctcaccaggagtcacaatgctttgcagtttatctgcggtaactaaatgttagttttgtaagtaaaaggtactgttattgacctcgaaagggctatagttcctttgaacttacagagaagagttccaaacaactatttctaaccaagatggaatatgggtcagcaaaattgtcttcaggtagagttttctacttgccaagagactttggcattgagaggagagttcttgtttgtttttttaactctgtatcatttctgtttggtgtctctaraaaaaaatccgracaatggg

SEQ ID NO: 392 - DNA, 303 bp, Homo sapiens
  CDS 252..302
  sig_peptide 252..290: Von Heijne matrix score 5 seq MLSGLVLNSWALA/YQ
tgaccttgtagcagttatctttgttaaactccttcatttcttattttaaataattaattaattaatttagagacagggtctcactatgtcacccaggctgtagtgcagtggtgcaatcatggctcactgtagccttgacctcccaggctcaagcaatcttcctacctcagcctctcaggcagctgggactacagacccacagcactacgcctgacttatgattttattttttgtggagacagggtcttactatgttgtctgggcttgtcttaaactcttgggccttagcctaccaactagctg

SEQ ID NO: 393 - DNA, 366 bp, Homo sapiens
  CDS 298..366
  sig_peptide 298..345: Von Heijne matrix score 5 seq VFFXGXSIILVLG/ST
  misc_feature 265: n=a, g, c or t Oligonucleotide
tttttccccgcccctgagaccctgcagcaccatctgtcatggcggctgggctgtttggtttgagcgctcgccgtcttttggcggcagcggcgacgcgagggctcccggccgcccgcgtccgctgggaatctagcttctccargamytgtggtcgccccgtccgctgtggcgggaaagcggtccccagaaccgaccacaccgtggcaagaggacccagaacccgaggacgaaaacttgtatgagaagaasccagactcccatggknatgacaaggaccccgttttggacgtctggaacatgcgacttgtcttcttcktwggcgkstccatcatcctggtccttggcagcacctttgkggcctatctg

SEQ ID NO: 394 - DNA, 126 bp, Homo sapiens
  CDS 21..125
  sig_peptide 21..68: Von Heijne matrix score 5 seq SDFFLLFVSLSLS/PF
agcttggcatataggctcaaatgttatcatcagatttttttctcctctttgtctctttatctttatctccatttcctttttttctttttcctcccctcttttcctgctttctcttacccacccggg

SEQ ID NO: 395 - DNA, 329 bp, Homo sapiens
  CDS 154..327
  sig_peptide 154..195: Von Heijne matrix score 5 seq FIAALFTVAKIWN/QP
tgaaaatgtaaattagtgcagttattatggmagtcagtatggaacttcctcaaaaaactaacaataaaactcccatatgatccagcaatcctaccactgratatttatccaaaggaaaggaagtcggtatatttaacaggcatctgcacccccatgtttattgcagcactattcacagtagccaagatatggaatcaacctaaatgtccatcaacggatgaatggataaataaaatgtggtacatatacacaatggagtactatccagacataaaaaagaatggaattctgacatttaaggcaacaaggatgaaccggaagacattatg

SEQ ID NO: 396 - DNA, 99 bp, Homo sapiens
  CDS 5..97
  sig_peptide 5..49: Von Heijne matrix score 5 seq VCGCLCVWMCVCG/XV
  misc_feature 49: n=a, g, c or t Oligonucleotide
gtatatgtgtgtgtgtgggtgtttatgtgtgtggatgtgtgtgtgtggnwttgtgtgtatatacatatgmgtgtatgtgtgtacatgtgtgagggggga

SEQ ID NO: 397 - DNA, 316 bp, Homo sapiens
  CDS 134..316
  sig_peptide 134..211: Von Heijne matrix score 5 seq LSLFVFFWLVGFS/FF
  misc_feature 284..285: n=a, g, c or t Oligonucleotide
ttgtgaactcttctattattattaagtgttgtcaattgtcagcatccatattctattccgatgatgaatagaagcattatatttcagcatcaaaatgcagttggggtcgtaatgagcatcattagggaccttaatgggagtcagaactgtatgtcattttattcaggtttttctaagtttatttgtgtttttttggttagttggtttttcttttttcttttttttacdbttttctaccaagcaggtgagagtwgaacagcattgtgattttaaaagtacaccanndgtagagtcttccagtaccgttggccatgcc

SEQ ID NO: 398 - DNA, 251 bp, Homo sapiens
  CDS 63..251
  sig_peptide 63..143: Von Heijne matrix score 5 seq LSCFYLLAIVSNA/VM
atgttgtagcttctgtcataatttccttcccttttaaggctgaataattttccattgtgtatatgtaccatattttgttcatccattcattcattgatagatacttgagttgcttctaccttttggcaattgtgagtaatgctgttatgaacatgggtgtacaaatgtctgttttgagtccttgttttgctttcgtgcattctattaaaaatgttaaggttctttgctttttacttttttttctctttggg

SEQ ID NO: 399 - DNA, 120 bp, Homo sapiens
  CDS 10..120
  sig_peptide 10..75: Von Heijne matrix score 5 seq VQWLLVYSPSCAA/TI
tcatttaccatgcagttcaccgttttaatgtgtccagttcagtggttgttagtgtattcacccagttgtgcagccaccatcacagtcaattttaaaacattttcatcaccccaaaccggg

SEQ ID NO: 400 - DNA, 463 bp, Homo sapiens
  CDS 342..461
  sig_peptide 342..452: Von Heijne matrix score 5 seq VSCLSAGLRVCCS/QR
  misc_feature 246,260: n=a, g, c or t Oligonucleotide
ctctgtccccgcggctgggtctcgtctgctccggttcctgggctcctaattcttggtccagcttcttccaggcacatcctcttctctgccctccgtccattttggagccggagatggtgggctkggggccgccccagtagtgagacagtggaagtaaaccccatctgccgttcccgtgcgtagagaaaaacgttgaccgcgaggctggggaggagagttgcctctgaggaagaagggcacagaganccaaaattagtttngaaagcatcctgatttggtgcccgaggcctggaaagaaatggcggctggggtgcggcggaggtaggggaggaaaacgttggatgagaagggcctggactcaggaaagggaaccgcgtccgtgtgagcccgctgagcgcgcagaccctgcccctgtctcctgtctgtctgcaggtctgcgcgtctgttgttcccagcgctctgc

SEQ ID NO: 401 - DNA, 206 bp, Homo sapiens
  CDS 94..204
  sig_peptide 94..168: Von Heijne matrix score 4.90000009536743 seq DFFICLLAICVSS/FE
tactgtttattgattctttgattatggccattcttacaggagtaaggtggtatcacactgtggttttgatttgcatttccctgatcattagtgatgttgcatttgatttgcatttccctgatcgttaatgattttttcatatgtttgttggccatttgcgtatcttcttttgagaattgtctatttatgtccttagcccacagtgg

SEQ ID NO: 402 - DNA, 330 bp, Homo sapiens
  CDS 42..329
  sig_peptide 42..230: Von Heijne matrix score 4.90000009536743 seq VTSLANLIPPVKA/XP
acagggctccactgcagttaggagccggtgagtccgggtggatgaggtcagagcgccccatggtgtggtgctgcctctttgtccgttcgcagcgaaaacggaaacagagcacccaagatgaagatgctgttagcctttgcagtctcgacataagtgagcctagtaataaacgggtcaaacccctttcccgagtcacgtcgctagcaaacctcatcccgcccgtgaaggccaygccattaaagcgcttcagtcaaaccctgcagcgctccattagcttccgcagtgagagtcgccctgacatcctcgccccccgaccctggtccagaaatg

SEQ ID NO: 403 - DNA, 311 bp, Homo sapiens
  CDS 168..311
  sig_peptide 168..227: Von Heijne matrix score 4.90000009536743 seq CILISTAFPSLLT/QI
tgagcagatggtgccaggatttaaacctatgtttatcagatgcagatgacccaaacagtggcttatctgttggtaatttttatttagatcaagttaaacataaatgactttgcattactctttggtcactttttcctagtcatttcaaatagtctgtcttatttctcatggttttttggacaaaattttgtattttaattagtacagcatttccttctttattgacacagattattttccctaaatctattacatttgctttccagtttttctggaacagggaaaaacaaaaaacaaaaacaccaactggg

SEQ ID NO: 404 - DNA, 274 bp, Homo sapiens
  CDS 80..274
  sig_peptide 80..190: Von Heijne matrix score 4.90000009536743 seq MLIMLGIFFNVHS/AV
ccctgcgagggcatcctgggctttctcccaccgctttccgagcccgcttgcacctcggcgatccccgactcccttctttatggcgtcgctcctgtgctgtgggccgaagctggccgcctgcggcatcgtcctcagcgcctggggagtgatcatgttgataatgctcggaatatttttcaatgtccattccgctgtgttgattgaggacgttcccttcacggagaaagattttgagaatggcccccagaacatatacaacctttacgagcatggg

SEQ ID NO: 405 - DNA, 153 bp, Homo sapiens
  CDS 69..152
  sig_peptide 69..116: Von Heijne matrix score 4.90000009536743 seq SALLLEXLQXAIP/RX
tttcccctgccctgtcctctcattccccttcttctggagcatttcatccacagaccccttgcccaagaatgtctgtctcagctctgcttctagagmtcctccaagmtgccatccctcgymamacctcaggcttmcaagacctgcccaactggg

SEQ ID NO: 406 - DNA, 206 bp, Homo sapiens
  CDS 57..206
  sig_peptide 57..173: Von Heijne matrix score 4.90000009536743 seq VIAIVSFTTLCSS/LY
aaataaaaaatattaaaaaataatctcatctttgattttagatttagggggtgtgcatgcaggcttgttatatgggtatgtggtatactgccgaggcttggggtacgattgagtccctcacccaggtagtgagcgtaatcgcaatagttagttttacaaccctgtgctcctctctgtattccccccaagtagtccccagtgttggg

SEQ ID NO: 407 - DNA, 479 bp, Homo sapiens
  CDS 277..477
  sig_peptide 277..462: Von Heijne matrix score 4.90000009536743 seq PLAACPLLLPIFS/HA
  misc_feature 22: n=a, g, c or t Oligonucleotide
aatggattgagatggggaaganaaaaagccccaaattcatgaaatgtagctgckacagtccccacctccttagctgtccccaaaacctaagcaggtaatcataacttccattctgtgctcaccttacctctgctggcacctttttggacagggttctctacttggcgaggtgacccaaatcttcattcctgcagggtctgagtcctmrgccgctgcgatcgtttgaacattgtttgtccccacmraaactcatcttgaggcttggtccccactgtaatgatgttgagaggtggcgggacatttaaggrgtgtttgagtcatgagggatccagcttcacgaagggattagcgcaggagtgcgtgagtrcttcttgtgggactcgattgattactgcagtwgccagtkgttacaaagcaaggctgcctctggccgcgtgcccdcttctgcttcctattttctcccatgctagaagcagcac

SEQ ID NO: 408 - DNA, 289 bp, Homo sapiens
  CDS 84..287
  sig_peptide 84..203: Von Heijne matrix score 4.90000009536743 seq SLKICGLVFGILA/LT
agccgactcacttgcaactccacctcagcagtggtctctcagtcctctcaaagcaaggaaagagtactgtgtgctgagagaccatggcaaagaatcctccagagaattgtgaagactgtcacattctaaatgcagaagcttttaaatccaagaaaatatgtaaatcacttaagatttgtggactggtgtttggtatcctggccctaactctaattgtcctgttttgggggagcaagcacttctggccggaggtacccaaaaaagcctatgacatggagcacactacggg

SEQ ID NO: 409 - DNA, 341 bp, Homo sapiens
  CDS 94..339
  sig_peptide 94..216: Von Heijne matrix score 4.90000009536743 seq LSLVSHAPGEALA/RA
gtgttgcagaaatccggcaatcgacctgaggacttgcgagccgctcagctcccgggacgtttggagctgctgctaaataatttctgctcagccatgtcgccggctccagatgcagccccggctcctgcgtcgatctccctgtttgacctcagcgcggatgctccggtctttcagggcctgagcctggtgagccacgcgcctggggaggctctggcccgggctccgcgtacttcctgttcaggctcaggggagagagaaagcccagaaagaaagctactccagggtcctatggatatttcagagaagttattttgttcaacttgtgaccagaccttccagaa

SEQ ID NO: 410 - DNA, 321 bp, Homo sapiens
  CDS 153..320
  sig_peptide 153..257: Von Heijne matrix score 4.90000009536743 seq LFIFIGSLQPVPT/RF
cacacacaaactctcaagtggcctaattccctctcaccaaaccaatcacaatacagataaaagagaataacttgtgttcatttttgtacaaacaaaaaagatataaattgtgaatgrtgcatgrtttttaawtwmccaagtaaactgggcaaatgcttctgcattatttaaagctaaaaggtgatcagtggaaactttcctctgttagtactctaatactttttatatttatcggctcactacaacctgtgcctaccaggttcaagcgattctcctgtctcgdccacctgagtagccgagaccacaggcaagcactacggg

SEQ ID NO: 411 - DNA, 635 bp, Homo sapiens
  CDS 84..635
  sig_peptide 84..542: Von Heijne matrix score 4.90000009536743 seq MIVSLAAVAWVGQ/QV
gggttgtggttggtgtgcgggtttcggttggaggactcgttggggaggtggcctgcgcttgtagagactgcatccccgagacgatggcggagggagataatcgcagcaccaacctgctggctgcagagactgcaagtctggaagaacagctgcaaggatggggagaagtgatgctgatggctgataaagtcctccgatgggaaagagcctggtttccacctgccatcatgggtgtggtttctttggtgtttctgattatctactatctagatccatctgttctgtccggcgtttcctgttttgttatgtttttgtgcttggctgactaccttgttcccattctagcgcctagaatttttggctccaataaatggaccactgaacaacagcaaagattccatgaaatttgcagcaatctagtaaaaactcgacgcagagctgtgggttggtggaaacgcctcttcacactaaaggaagaaaaacctaagatgtacttcatgaccatgatcgtttcccttgctgcggttgcttgggtgggacaacaagtccacaacctgcttctcacctacctgatagtgacttccttactattgcttcctggactaaaccaacatggaatcattttgaagtacatt

SEQ ID NO: 412 - DNA, 335 bp, Homo sapiens
  CDS 33..335
  sig_peptide 33..110: Von Heijne matrix score 4.90000009536743 seq LLRGLLAGPAATS/WS
aatggacgagaggtcagggtaggtttttgaagatggcggccctcaaggctctggtgtccggctgtgggcggcttctccgtgggctactagcgggcccggcagcgaccagctggtctcggcttccagctcgcgggttcagggaagtggtggagacccaagaagggaagacaactataattgaaggccgtatcacagcgactcccaaggagagtccaaatcctcctaacccctctggccagtgccccatctgccgttggaacctgaagcacaagtataactatgacgatgttctgctgcttagccagttcatccggcctcatggaggcatgctgccc

SEQ ID NO: 413 - DNA, 158 bp, Homo sapiens
  CDS 25..156
  sig_peptide 25..93: Von Heijne matrix score 4.90000009536743 seq LVGFKQVVAWTFA/SD
  misc_feature 17: n=a, g, c or t Oligonucleotide
agaaactgacatttgbntgttttaatggggtccctgctgttcatcaggcagacacttgtgggctttaaacaggtcgttgcttggacctttgcttctgattcacattgtgsaaawgtggwwatggtdwtctwsagtcagttgarwaatcccccactggg

SEQ ID NO: 414 - DNA, 202 bp, Homo sapiens
  CDS 59..202
  sig_peptide 59..130: Von Heijne matrix score 4.90000009536743 seq LLLRGSLLASXRA/XX
  misc_feature 160: n=a, g, c or t Oligonucleotide
ctgggagcgaccgctccgctcgtctcgttggttccggaggtcgctgcggcggtgggaaatgctggcgcgcgcggcggaggrcactggggcccttttgctgaggggctctctactggcttctgrccgcgckycgsysvcgcctcctctgggattgscccgnaacaccgwtggtactgttcgtgccgcagcaggaggcctgggt

SEQ ID NO: 415 - DNA, 229 bp, Homo sapiens
  CDS 146..229
  sig_peptide 146..196: Von Heijne matrix score 4.90000009536743 seq LLSFCLCSDFISQ/DA
gtmaaactcccgcagacttctctgtagatcgctgagcgatactttcggcagcacctccttgattctcagttttgctggaggccgcaaccaggccctactcaaccctccttcccaggaggcccaggcccccaagctcagatcacccatgaatgcctccctcttgtctttctgcctttgttcagatttcatctctcaagatgccctccttctcactgtcatatttcctccc

SEQ ID NO: 416 - DNA, 265 bp, Homo sapiens
  CDS 27..263
  sig_peptide 27..206: Von Heijne matrix score 4.90000009536743 seq LVGVIVHSGQAHA/GH
atgatgaacaaataaggtttccctggatgctaaacatggagccttacacagtttcaggaatggctcgccaagattcttcttctgaagttggggaaaatgggcgaagtgtggatcagggcggtggaggatccccacgaaaaaaggttgccctcacagaaaactatgaacttgtcggtgtcatcgtacacagtgggcaggcacacgcaggccactactattccttcattaaggacaggcgagggtgtggaaaaggaaagtggctggg

SEQ ID NO: 417 - DNA, 228 bp, Homo sapiens
  CDS 160..228
  sig_peptide 160..219: Von Heijne matrix score 4.90000009536743 seq LHLXSSRXPPILA/SP
  misc_feature 166..167,190: n=a, g, c or t Oligonucleotide
ttgtctgtcttaggcctggacactgttgttgacttatttccagattttaatttctctttggttgaagactgccaactgtctcatagagtgtttgatttatttatttattyathtwgacatgaggwykctctctgcmaacccaggctggaktgcagtgacatgatvnnggctcacttcagcctccacctcnkgagctcaaggartcckcccatcttagcctccccagta

SEQ ID NO: 418 - DNA, 225 bp, Homo sapiens
  CDS 125..223
  sig_peptide 125..175: Von Heijne matrix score 4.90000009536743 seq VCELSIFFTYVLA/IY
aaaagtttgtaataagttgcactttcatcaagactgtattagggagtccagtctccccacatccttgtcagcacgggatgacatcagtcttttaaatcttaccaacttattgggaaaaaaaaaaatgatacgtcctgtttgtgaattgagcatttttttcacctatgtactagccatttacatatctccttctgtgaattgtctgtttatatcctttcctgcggg

SEQ ID NO: 419 - DNA, 293 bp, Homo sapiens
  CDS 42..293
  sig_peptide 42..128: Von Heijne matrix score 4.80000019073486 seq LLSARLLSQEKRA/AE
gtgctctatggagctattgcggccgtgggtggtcgcgggcratgcggggctgccagctcctcgggcttcgtagctcttggcccggggacctactaagtgctcggctcttgtcccaagagaagcgggcagcggaaacgcactttgggtttgagactgtgtcggaagaggagaagaggggggacttaacatcagttgtaagtctagagtaccctgaagtgcaattacagggtcaaagggtctatgcmttcctgtcacccatttgtacctatggctctgagggatgcagcctcaag

SEQ ID NO: 420 - DNA, 194 bp, Homo sapiens
  CDS 30..194
  sig_peptide 30..134: Von Heijne matrix score 4.80000019073486 seq PWVLDIFLTLVFA/LG
agttgctagaaagcaatgcgcctattcacatggagaatcttccctttcctctaaaattacttagtgcctcatcactaaacacccccagctccacaccatgggtgttggatatcttcctcaccttggtgtttgccctggggttcttcttcctattactcccctacttctcttacctccgttgtgacaacccacca

SEQ ID NO: 421 - DNA, 90 bp, Homo sapiens
  CDS 29..88
  sig_peptide 29..67: Von Heijne matrix score 4.80000019073486 seq MCVCVFAIFGVRC/CV
  misc_feature 61: n=a, g, c or t Oligonucleotide
tatttgggatttgttgctctgtgtgtatatgtgcgtgtgtgtgtttgctatatttggggtncgttgctgtgtgtgtgtccgctgtatttg

SEQ ID NO: 422 - DNA, 161 bp, Homo sapiens
  CDS 22..159
  sig_peptide 22..153: Von Heijne matrix score 4.80000019073486 seq XPCPLLFPGACFP/CP
tcatttgggtttttatttaatatgatttgcatattttactctaagatttccatctctgtcggctgtgggaggacagcagccgagcaagttggatgtaaacagaggtcatttcacckcccytgccctctgctgtttcctggtgcdtgctttccctgcccaac

SEQ ID NO: 423 - DNA, 420 bp, Homo sapiens
  CDS 333..419
  sig_peptide 333..380: Von Heijne matrix score 4.80000019073486 seq ICVSLMASDGASS/PV
  misc_feature 323..324,328: n=a, g, c or t Oligonucleotide
ctgccgcyggacacgggttcttccagcttttggctattgtgaataacgctgctatggacatgaatgtacaaacatcccttcagatcctcctttcagttcttgtgggtacataccccgagtggaactgtggcatcatatggtaactctgtgtttaacattttgaggaaccaccctactgcttcccacagaggctgtaccagtttacttcccaccaacagtgcaaggattccaatttctccacatccgtgccaacactattttctttttgtcgctgttgtcattgtttgtctggaaaatagccatgctgaggggtgagaggtgrnnghanrgttatgaatttgatttgcgtttccctgatggccagtgatggggcatcttcccctgtgcttggtggctcttcacactcttcctcccwtrggg

SEQ ID NO: 424 - DNA, 432 bp, Homo sapiens
  CDS 256..432
  sig_peptide 256..396: Von Heijne matrix score 4.80000019073486 seq LVSALPQASFSSS/SE
agtgaggagtcarggaggtgtgtgtgagagagagagagaaaagagagagacagagacggggagagagagagggagagagaagagagggaggagggaagaagaaaagacggagggaggtgaggaggaagggagggggagagacagagacctagaggggctgaagacccagacagagctggcagagctactgagaagaggactggagcgctctgagagcctctcaagatcttttgggggagcccaataaatgtgaacatgggatctgtcacrggagctgtcctcaagacgctacttctgttatctactcaaaattggaacagagtcgaagctgggaattcctatgactgtgatgatcctcttgtgtctgccttgcctcaggcatccttcagcagttcttccgagctctccagcagtcatagtcctggatttgca

SEQ ID NO: 425 - DNA, 419 bp, Homo sapiens
  CDS 278..418
  sig_peptide 278..370: Von Heijne matrix score 4.80000019073486 seq FFLLFLFSSCDVP/VP
ccgaattattttagtgttacttatctttgaataaaatgtatttttcttggatcaattagttgcagcacgttcttaggaatggaatagagaagcatcctaagccagaaggatttttttttttctagatcacagtgaagctttaatatggkkggatatttgtcccagcccaaatcccatgctgaattgaaacccctagtgctggaggtggggcctggtggaaggtgtttggatcatgaggacacatctctgatgaatggcctagctcatcctcttagtgatgatgagtgagtyctcacaagatctggttgtaaagtgtgccccaccacsgccattctttctcttgttcctgttttcttcatgtgatgtgcctgttccccttcaccttctgcaatggctgcaaagcttcctgaggcctaggg

SEQ ID NO: 426 - DNA, 232 bp, Homo sapiens
  CDS 54..230
  sig_peptide 54..134: Von Heijne matrix score 4.80000019073486 seq VLLTSGVKPQTFA/VS
gcagtgagtgttacagttcttaaagatggtgtgtccggagtttgttccttccaatgttcagatgtgtccggtttcttccttctggcgggttcgtggtcttgctgacttcaggagtgaagccacaaaccttcgcagtgagtgttacagctcttaaaggtggcatgcccggagttgttcattcctccggtgggttcgtggttttgctaacttcaggagcgaastgcagaccttc

SEQ ID NO: 427 - DNA, 383 bp, Homo sapiens
  CDS 226..381
  sig_peptide 226..315: Von Heijne matrix score 4.80000019073486 seq CLFLNARLAGTLC/QL
acagacatcagctcgggtcaaccgcgggcctcgagcccgagtggctgagggctgttaccttcaaacctttgaatcccacgttttccccttgacttcctgtcaccgttagagaaaagtggacagcgtctcggtcacagagttggagaaatagtgcagggactcttcagggagagcgttttcctcatcaaagcaaactgcaaaatcgcttctgccggcgtggacctgatgagagtcggtcgtcgtgagggacaccctctgttccctaacgtcccccgctgcttatttttaaacgctcggttggcgggaaccctgtgccagctgaaactccttcagtttggccgcctaggaaacaccgagagtcacctacatgggctggctggggg

SEQ ID NO: 428 - DNA, 132 bp, Homo sapiens
  CDS 32..130
  sig_peptide 32..124: Von Heijne matrix score 4.80000019073486 seq LLCPLTCPHHSLS/TV
ttcaacaaatgagtcatagtgttttcgtattatgtattttgatatccagattgtctcagatgtggtcagcgggattcccttcaaacttctgtgccctttaacatgtccccatcattctctgagcaccgtggg

SEQ ID NO: 429 - DNA, 165 bp, Homo sapiens
  CDS 25..165
  sig_peptide 25..117: Von Heijne matrix score 4.80000019073486 seq FSPFLPSLPLLEA/ER
caaactgttgaaaagttaactcttatgttatttatattttcagacatagattggaagatggacttatgctttttctctttctctcctttccttccctcccttcctttgttggaggctgaaagaatgagggtcagtgatcaacttcagtataccactggakacggg

SEQ ID NO: 430 - DNA, 236 bp, Homo sapiens
  CDS 52..234
  sig_peptide 52..159: Von Heijne matrix score 4.80000019073486 seq VLLAIGMFFTAWF/FV
gccgacgtgttcttccggtggcggasggcggattagccttcgcggggcaaaatggagctcgaggccatgagcagatataccagcccagtgaacccagctgtcttcccccatctgaccgtggtgcttttggccattggcatgttcttcaccgcctggttcttcgtttacgaggtcacctctaccaagtacactcgtgatatctataaagagctcctcatctccttagtggcccgagg

SEQ ID NO: 431 - DNA, 354 bp, Homo sapiens
  CDS 239..352
  sig_peptide 239..289: Von Heijne matrix score 4.80000019073486 seq LKLISTNFSLCQS/VQ
  misc_feature 345: n=a, g, c or t Oligonucleotide
aggccttctgagtgcagctggcaccatgggtgtgctccagagcaacttctgcttgctctgagccccctgccctgcctcccctttcaccatgtttcctctgacaagattttaagtacagcaattcaagaagatttctcctcctaaacgacatttatctgaagtctattgcctcttgattgctggaaaagadtcttaaaatcatttcaaaagtaacttataaacaaacttattaaaagtgatgaaaggagcattgaaattaattagcactaatttttcactgtgccaaagtgtgcagtgtccttcagaggaaacaataacagatctggtgagtgtgccatgccagtngggactggg

SEQ ID NO: 432 - DNA, 431 bp, Homo sapiens
  CDS 153..431
  sig_peptide 153..359: Von Heijne matrix score 4.80000019073486 seq MMVLSLGIILASA/SF
gtaaaaaaacactggaataaggaagggctgatgactttcagaagatgaaggtaagtagaaaccgttgatgggactgagaaaccagagttaaaacctctttggagcttctgaggactcagctggaaccaacgggcacagttggcaacaccatcatgacatcacaacctgttcccaatgagaccatcatagtgctcccatcaaatgtcatcaacttctcccaagcagagaaacccgaacccaccaaccaggggcaggatagcctgaagaaacatctacacgcagaaatcaaagttattgggactatccagatcttgtgtggcatgatggtattgagcttggggatcattttggcatctgcttccttctctccaaattttacccaagtgacttctacactgttgaactctgcttacccattcataggacccggg

SEQ ID NO: 433 - DNA, 201 bp, Homo sapiens
  CDS 37..201
  sig_peptide 37..156: Von Heijne matrix score 4.80000019073486 seq IVSAACKCGSSQA/AI
aatatttatgaagcagtttggaaccaaaggggtagtatggtagacgagtgtcttacagagcctgtgtggggaagcaaaaggcaagggtgtagttcacaggcagaagcgagctgtgacattgtcagtgcagcgtgtaagtgtggctcctcacaggcggccattgattgtgagacctcatcttgctctgaagatttcccggtg

SEQ ID NO: 434 - DNA, 334 bp, Homo sapiens
  CDS 242..334
  sig_peptide 242..283: Von Heijne matrix score 4.80000019073486 seq AWWFSGTFPLTHP/CS
aagctgtactctttcagcacatttcctttcatctcccccttcttccctcttctgtgctctcaagactttccccctcttgctgccacagatgcagtgaagcctgccatatataaggtacaatgtgtggcaactctgcaggtggggtctatgcaagctacagacccctctgagtgtggtcagtgccttagcctggcctggatgcctaccaggccccaccaacacctagctgctggatattataatggcatggtggttttctggaaccttcccactaactcacccctgcagcggatacggctctctgatggctccttctagccctaccccttctggg

SEQ ID NO: 435 - DNA, 386 bp, Homo sapiens
  CDS 152..385
  sig_peptide 152..322: Von Heijne matrix score 4.80000019073486 seq VTSLANLIPPVKA/TP
agtcgagtcctgcccggctagaagccggctgtcggtctccgtgtcgccgccgccgcccggcatcgtggagctggggcccccttttgcctgggagttttgtagtcgcctagggtcagcggtgacatcccaaagggcaggcccggcagccgccatggtggccaaggattaccccttctacctcacggtcaagagagcgaactgcagcctggagctacctccggccagcggtccggccaaggacgctgaggagcctagtaataaacgggtcaaacccctttcccgagtcacgtcgctagcaaacctcatcccgcccgtgaaggccacgccattaaagcgcttcagtcaaaccctgcagcgctccattagcttccgcagtgagagcgcct

SEQ ID NO: 436 - DNA, 472 bp, Homo sapiens
  CDS 191..472
  sig_peptide 191..274: Von Heijne matrix score 4.80000019073486 seq GVLLEPFVHQVGG/HS
tttttttggtgcgagagaaacaataggacggaaacgccgaggaacccggctgaggcggcagcgagcatcctggccagaacaagccaaggagccaagacgagagggacacacggacaaacaacagacagaagacgtactggccgctggactccgctgcctcccccatctccccgccatctgcgcccggaggatgagcccagccttcagggccatggatgtggagccccgcgccaaaggcgtccttctggagccctttgtccaccaggtcggggggcactcatgcgtgctccgcttcaatgagacaaccctgtgcaagcccctggtcccaagggaacatcagttctacgagaccctccctgctgagatgcgcaaattcactccccagtacaaaggacaaagccaaaggccccttgttagctggccatccctgccccattttttcccctggtcctttcccctgtggccacaggga

SEQ ID NO: 437 - DNA, 469 bp, Homo sapiens
  CDS 213..467
  sig_peptide 213..314: Von Heijne matrix score 4.80000019073486 seq ILAFLQSPRAILP/GN
  misc_feature 432..433: n=a, g, c or t Oligonucleotide
ggattcccgccccgaggtttctaaatccagacattcccgtttggctgagcactctaggcctacatccatgaagctaggagagcgacactcaaagactgcactattgagagaagctaacgttaaaggcagtgaatatattcgggagtccagctccggaacccgggagctcttttagtgggaggggcggcgctgatggcgcttctggcctccgaatgctagggggcgctgtgatcgccgggcggcctcttgggcgctgggagtccaccgcgcaasscatcctggcctttcttcagtccccacgtgcgatccttcccggcaactttttcgagaaaaatgcccaaattcaaggcggcccgtggggtggggggtcaggaaaaacatgcgcccctggccgatsagatcctggctgggaatgcggtgcgggcgggggtnngggagaagcggcggggtcgcgggamaggaraagcgg

SEQ ID NO: 438 - DNA, 169 bp, Homo sapiens
  CDS 77..169
  sig_peptide 77..124: Von Heijne matrix score 4.80000019073486 seq ACFFHLFVSSLIS/FE
ttgataggaatagcattgaatctgtaaattgctttgggcactatggccattttaataatattgattcttcctatccatgagcatggcatgttttttccatttgtttgtgtcatctctgatttcctttgagcagtgttttgkaatgctaagaaaattgcttaaaattata

SEQ ID NO: 439 - DNA, 447 bp, Homo sapiens
  CDS 211..447
  sig_peptide 211..345: Von Heijne matrix score 4.69999980926514 seq PWLEVGLFFWLHA/AP
agaacaatgctgcttggctccctgaattcagcacccttcctagggaatgtatgggtggatcttttgccttgcaggattctttttcatctttgcagggacttctggggccggagtatgtaaaactcctgggtctctgtgtgtgcctgagtggctgctctactgagactctgcatacacagctctgtatatcggacccawggccctggtggcatgggctcacgaggagatcccctgatctgtgggttgcaaagatctgtgggagaagtgtggtttcctggatggggtcacacaatcactcactgcttcccttggctggaggtggggctttttttttggctccatgctgctcctgggcgggcgattgccctaccccatttttcttcattctctgtgggtcaagdbgttcacttggtcagtccattgtgrgamctggatatttcagttgaa

SEQ ID NO: 440 - DNA, 340 bp, Homo sapiens
  CDS 176..340
  sig_peptide 176..232: Von Heijne matrix score 4.69999980926514 seq ELLLLLPRGLCQV/CP
  misc_feature 20,279..281: n=a, g, c or t Oligonucleotide
agaaaagcagccgcagttgngccgctccaccacgccgtccgggtgggcctagcagtcgctccatttatcgcttgagatctccagccttaccgcggctcgaaatggaccccaactgctcctgcaccactggtgtctccwrcgcctgcaccggctcctgcacgtgcaaagagtgcaaatgcacctcctgcaagaagagctgctgctcctgctgccccgtgggctgtgccaagtgtgcccacggctgtgtctgcaaagggmcgttggagaactgcagmtgcnnnkycctgatgtgggaacagctcttctcccagatgttaatagaacaagctgcacaacctgg

SEQ ID NO: 441 - DNA, 409 bp, Homo sapiens
  CDS 292..408
  sig_peptide 292..375: Von Heijne matrix score 4.69999980926514 seq QLVTRLLLSPSQS/TQ
agaagatggggaaagaggaaggaaaggatgcccagatacagggagctttagcgatgtagtgaacggacagaagatcaggaacaagttgagttcattgtgtggagatggcarraagatggagattggtgagctgagtggagaagtgccatagagcggtgttttgccagagtgtctgcggattgctcatacctgggaaggattctttgtatggttcccttaggctgagggagggtatcagctttacagaccttgtgggattacaaaagggccaccacacactcttcaaccaatatgtgtctatcttgcattcaaggctcattctttgttgaaattttgcagttggtcactaggctattgttatctccatctcaaagtacacagacacacacacacacacacacacacacaa

SEQ ID NO: 442 - DNA, 320 bp, Homo sapiens
  CDS 203..319
  sig_peptide 203..298: Von Heijne matrix score 4.69999980926514 seq AILLLVXVSDKNE/QQ
  misc_feature 225..227,279: n=a, g, c or t Oligonucleotide
cacactagaatagactggaacaacttggatttagtgattccgatgcttatcaggaaggtctctgttcttttataggaagaaaaaacatagttatttttcttttatgatacaaaggtatgctttctatgcaagctggataccagaccaagaataataaatcacaatttcataaggtttctaagacttgatattatatggggatatgaccattttgagggaaatgtnnncatcactttatgtacttgaagctaaggatactgctatcttattgcttgtttnagtgagcgataagaatgaacagcagcttgggaggggcgtgg

SEQ ID NO: 443 - DNA, 256 bp, Homo sapiens
  CDS 102..254
  sig_peptide 102..188: Von Heijne matrix score 4.69999980926514 seq ICCNLYFLLFCRS/SF
cttctttgtaactcctgcatatacctttgcatttatgtagcttctggagggcacatggaggtagctcaccatggttttaatttgcatttctctgataatgaatgagacttagttcttcctgtgggttgcctgttaagactttgccatttatctgttgcaatctttatttcttgctgttttgtaggagttcttttttatattttggatatgatcccattaatacttacatgtattacaatgttttctcccactcggg

SEQ ID NO: 444 - DNA, 284 bp, Homo sapiens
  CDS 17..283
  sig_peptide 17..220: Von Heijne matrix score 4.69999980926514 seq GCLLXPLLVSCLG/SL
tagatggcgactccctatgttactgacgagaccggcggtgagtgcgggaggcgcggascgcttctctccgggctctcggggcaggggttcggacttggaaaggggtctgtgccccgcccatcccggggcccctcctttgccccgccccccggaccgccttccccattcattctctcctacggggtgtctcctghgcccccttctggtctcgtgtttggggtctctgcttccggtcacccaaaccctggggtccttcagtgctggtccctgcttcaggaccctca

SEQ ID NO: 445 - DNA, 240 bp, Homo sapiens
  CDS 103..240
  sig_peptide 103..177: Von Heijne matrix score 4.69999980926514 seq ILXSLSSSVPSRA/GS
tcttttgtaatgaagcatggcagccaggcctagcacacttccctctgcacaccatcctgctcaggcctctgtgcctcggctgtgctgttccttctgcttggaatgcattcactgtgtccacttagccaattcctacctattctttmaagcctcagttccagtgtcccctcgagggcaggcagtgctttcccatctgccctaggtccactctaccagcctctacttgggcccccagcatgg

SEQ ID NO: 446 - DNA, 184 bp, Homo sapiens
  CDS 8..184
  sig_peptide 8..139: Von Heijne matrix score 4.69999980926514 seq LVFLSVXLLFLLF/LV
tccttttatgcgaacacaagtatatgaggggttgtgtaaaaattatttttctcttgctgtactacaaagagatagaatcaaactgctttttttcgacatactggtttttctttctgtttwwcttctctttcttctatttcttgtggatatwatggctaatadcacaacaagtttagggaggccc

SEQ ID NO: 447 - DNA, 360 bp, Homo sapiens
  CDS 34..360
  sig_peptide 34..168: Von Heijne matrix score 4.69999980926514 seq LLSLAQTTTKTTA/TT
  misc_feature 280: n=a, g, c or t Oligonucleotide
aaaaactcttttctttatcctctttccagaaaaatgggccaattcacagctgcaatggttgggagaatttcctgtctgggagtctggaaactgccaagagtggaaagctgcagccagccagcgaggcctctgttgtcactggcccaaacaacaacaaaaacaaccgcaacaacaacaacaacaacaaaacatgccacgtgtgcactggcatatacaaacacgcccacagaaccavrccaagcggacaaggcttcaaggagagcttctgggahvctcrwvnccgcggcgaggcatatcccttggcatggtgccactgcagcccagctcccagcccccccgccatctgtcatcagcgctctg

SEQ ID NO: 448 - DNA, 123 bp, Homo sapiens
  CDS 39..122
  sig_peptide 39..92: Von Heijne matrix score 4.69999980926514 seq IAILFPNSGSCFA/FS
cttatctgattcacagcccgtattcagatttgccaattatgttgattttcattattgctattttatttcccaattcaggatcatgctttgcatttagttgtcatgtctccttttttttttttt

SEQ ID NO: 449 - DNA, 193 bp, Homo sapiens
  CDS 18..191
  sig_peptide 18..62: Von Heijne matrix score 4.69999980926514 seq RCACFPFFPFAFC/HD
ctctctcctgttcggtcatggtgagatgtgcttgcttccccttcttccccttcgccttctgccatgactgtaagtttcttggggcctcccagtcatgcttcttgttaagccggcaaaactgtgtaagcacaggakgaccttcatccaaatctgatatcaactcaaggtctggatcttgttcactggcaagggg

SEQ ID NO: 450 - DNA, 302 bp, Homo sapiens
  CDS 8..301
  sig_peptide 8..88: Von Heijne matrix score 4.69999980926514 seq LAPLXLVFISLLP/AP
  misc_feature 292: n=a, g, c or t Oligonucleotide
ccagcaaatggtgagtttgagggtaggggcctctccatttcggttcccactggcccccctctbtttggttttcatctctcttctcccagccccattttttcctactctttcgtttccttgttgctgtgtgtcctggctcttttctctttctgtgvttgtctctctgcgtctcagtctttbtgtgtcctgtttatctctctggtgtctcttggtattgtttctctctcccactctgtatgtctctgactcattctgctcattctgtgtcctccctattgctctctgtccccangctcgttctt

SEQ ID NO: 451 - DNA, 367 bp, Homo sapiens
  CDS 150..365
  sig_peptide 150..311: Von Heijne matrix score 4.69999980926514 seq PGLAFLAILTVLA/KP
aaaatgatccatgcacacagcctctataggaaagaaaaaaaatatccaattgattttcttcccttttctgcttctaaagtataccaaatttcactgtgatcttaatattccccagaacagacacctctgagcagagagcaggccttagaatggcccacccctgtttagctccagcagaaccttctactctttcacaaacckcccatccaattcaaagaaccctgacaactttccctcaggcttgggttctaaccagcagcttttccatacagccaggccttgcattcctagccattctcaccgtgttagccaaacccggstcctctamctggagtcctggtcagttcacaccacactccctgctggg

SEQ ID NO: 452 - DNA, 349 bp, Homo sapiens
  CDS 244..348
  sig_peptide 244..336: Von Heijne matrix score 4.69999980926514 seq HLYXSLFSSFLCS/TP
ttctttcarktcttactactcatccttcatttatctcctggatcattgcccagagaatgaaagaaattgccagtcaagccagccaggtaggttaaatctatcctggcagtcctggagactgctgcagactgactgcctgatgtccgtgcccactggggtttttcccttttcagaaaggatttctccctgatctctccccacaaactctggctttgctttttcatttcctaagagcaactcaatatgcatttccccatccaagctaccttcsactattcccctactgattctctctgtcatttatatttktcactcttctcttcctttctctgctctacccctgcccggg

SEQ ID NO: 453 - DNA, 270 bp, Homo sapiens
  CDS 87..269
  sig_peptide 87..194: Von Heijne matrix score 4.69999980926514 seq SCFVPSLVTGALQ/QS
agcagtccagagaagtgaaatgacttgcctgaagccacagagcctgcaagtgcgagggctgggattccaatccaagctctgggccaatggctttgcatatcctagaatgcgagaggaacgtttgttttgtagcagttagacagcctgctcatgaaagctgctttgtgcccagccttgtgacaggtgctttacaacaatcccagacacagcacccaccttgggtttgccctcaggtacagggctcctatccatcctggaagaacagaggga

SEQ ID NO: 454 - DNA, 492 bp, Homo sapiens
  CDS 317..490
  sig_peptide 317..412: Von Heijne matrix score 4.69999980926514 seq RVLXLCNSRVSFT/RX
  misc_feature 415..416: n=a, g, c or t Oligonucleotide
taaggatattacaaaacattttataaacacgtgggtctcttatgaagtacaatccaaagtttgcatacaatttaaaacaaaagcaagaaatgtcacgctttgggaacactgtttktctcacactaaaatgttctatctgaagcaaggggaagtgtccaaattatagttcacaaaatacctttattttctcacaacaaaatcatccctagtcagcggcccaacattactcatttctgtcatcaaaaacaccctttctgtgggttggtatgaaatatccgcaggcatcacaagtactataagaaagggctttttcaaaatgtcctgtactcactcctcttctaacctgggtaagttttctgtacacagagagtaccgtgtcctcmtactgtgtaacagtagggtctctttcactcgnntccatgtgaagagaccaccawacaggctatgtgtgagcagcaaaggctgtttatttcacctgggtgcaggcaggct

SEQ ID NO: 455 - DNA, 177 bp, Homo sapiens
  CDS 56..175
  sig_peptide 56..112: Von Heijne matrix score 4.69999980926514 seq AFPLLLVIILLFQ/KQ
cacattcataagtatgagcttaggctgaggatatatatccagtgggggatgaaacatgcttaagaaattgagtgcatttcctttattattggttattattttgctatttcaaaaacaawttggacttttaaaaaattatamttcaccacagagacaggtgttgttttgtaatcgaag

SEQ ID NO: 456 - DNA, 102 bp, Homo sapiens
  CDS 14..100
  sig_peptide 14..67: Von Heijne matrix score 4.69999980926514 seq CIFLAVLSKISWA/VN
ctaattgaaaaggatgtcctatttccgatgtatatttttggcagttttgtcaaaaatcagttgggctgtaaatatgtgcagtcttatttctgggtcctcggg

SEQ ID NO: 457 - DNA, 151 bp, Homo sapiens
  CDS 35..151
  sig_peptide 35..136: Von Heijne matrix score 4.59999990463257 seq LFLSISLITLYYS/SE
tgagttaaattagacaactgtaagagaaaaatttatgctttgtataatgtttggtattgaaactaatgaaattaccaagatgacaatgtcttttcttttgtttctaagtatcagtttgataactttatattattcctcagaagcatgtggg

SEQ ID NO: 458 - DNA, 285 bp, Homo sapiens
  CDS 16..285
  sig_peptide 16..132: Von Heijne matrix score 4.59999990463257 seq YVFXLLAPFLTRS/SP
  misc_feature 251: n=a, g, c or t Oligonucleotide
agacctccagaaaccatgtgtcaagctcggattgccttagacaggtgcaatttaagaacagctttcatcctctttkctctcatattgtcacactatgtgttcygacttctggctcctttcctcacaagaagctcacccagctggaactcttatgggaccttggcaccagagaccacaaattcctctttgaagttttctaacagcaacaatggtatttctgacttggcttwcttgtatttctcdcacgttancaaaattggttcagcatctaccatgggctacggg

SEQ ID NO: 459 - DNA, 311 bp, Homo sapiens
  CDS 15..311
  sig_peptide 15..86: Von Heijne matrix score 4.59999990463257 seq QGMLLAILEXCGA/IP
tcctcaagttcttcatggtcaagtccgtcatctttctttccttctggcaaggcatgctcctggccatcctggagragtgtggggccatccccaaaatccactcggcccgcgtgtcggtgggcgagggcaccgtggctgccggctaccaggacttcatcatctgtgtggagatgttctttgcagccctggccctgcggcacgccttcacctacaaggtctatgctgacaagaggctggacgcacaagtgccaacatacggcccttacggccgctgtgcccccatgaagagcatctccagcagcctcaaggag

SEQ ID NO: 460 - DNA, 425 bp, Homo sapiens
  CDS 161..424
  sig_peptide 161..418: Von Heijne matrix score 4.59999990463257 seq AAAALCILILLXA/MY
aggccgggctgatgcgcaggcaatttatcatcttgatctcccactgagtcagggagctctcctgtcaccagtattgatttcagaggatggactaaatttcctaggatttccattaagaattaagaaaaaagctctaagcacgcagggtagccagacagacatggatatgagatggcactgtgaaaactcgcagaccacagatgacatccttgtggcctcagcagagtgtcccagcgatgatgaggacattgacccctgtgagccgagctcaggtgggttagccaacccaacccgagcaggcggcagagagccgtatccaggctcagcagaagtgatccgggagtccagcagcaccacgggtatggtcgttgggatagtagccgctgccgccctgtgcatccttatcctcctcwatgccatgtaca

SEQ ID NO: 461 - DNA, 420 bp, Homo sapiens
  CDS 45..419
  sig_peptide 45..104: Von Heijne matrix score 4.59999990463257 seq PTLLTLCIGSVVS/SD
aaaaagctgtgggctcagaagcagagttctggggtgtctccaccatggcctggacycctctctggcccactctcctcactctttgcataggttctgtggtttcttctgacctgactcaggaccctgctgtgtctgtggccttgggacagagagtcaggatcacatgccagggagacaacctcgaagagtattttgcaagctggtaccgacagaggcccggacaggcccctgtccttgtcatctatggtaaaaacaaccggccctcagggattccagsccgrktctctggctccaagtcaggcaatacagctttattgaccatcgycggggctcaggcggaggatgabgctgactattactgtagtkatcgcgaccatactgataatcggtgggtgttcggcggggggaccaggctgacag

SEQ ID NO: 462 - DNA, 257 bp, Homo sapiens
  CDS 46..255
  sig_peptide 46..105: Von Heijne matrix score 4.59999990463257 seq XILTCLIFRNSEG/FQ
tttttttttttccccaagcgaaswtgaacagttgctaagtggaaaatggaggctgaattttacatggkgattcttacctgcttgatcttcaggaactcagaagggtttcagattgyccatgtccagaaacaacagtgtcttttcaaaaatgagaaagtggtcgtgggctcatgcaacaggaccatccagaaccagcagtggatgtggactgaggatgaaaagctccttcatgttaaatctgcactgtgcttggccat

SEQ ID NO: 463 - DNA, 117 bp, Homo sapiens
  CDS 61..117
  sig_peptide 61..111: Von Heijne matrix score 4.59999990463257 seq ACALCVWLCVKSC/SI
aataggaagacaaaagacaaaaaaaaatccaccaccaccaaaatatccctttgtacatgtatgtgcgtgtgcgcgtgtgctttgtgtgtgtggttgtgtgttaaatcatgcagtatt

SEQ ID NO: 464 - DNA, 142 bp, Homo sapiens
  CDS 39..140
  sig_peptide 39..101: Von Heijne matrix score 4.59999990463257 seq FIYLLAFCMPSLE/KC
cttattgtggattgtggttttaattttgtatttccctgatgattagtgatgttcagcaccttttcatatacttgttagccttttgtatgccttccttggagaaatgtctatacgggtctttggcccactttttttttttttt

SEQ ID NO: 465 - DNA, 300 bp, Homo sapiens
  CDS 216..299
  sig_peptide 216..260: Von Heijne matrix score 4.59999990463257 seq LFRVLFSXTCALX/QD
agttacttctttgctaggttgaggaaagggtggaagcgcctcctgcagccacgaatatcctccagtgcctgagagaaaacggcctaatcgaaaacgtccgcggcatacatccattcttaaaacttgagtggctgcttttctgggtggaaaagagcggtatcagacagggtgagcagtcggggaacggatgaacaaagacttgcaccgtggccctgatgcctttgttccgagttctattcagttgwacttgtgcgttgtwacaggactttagaatgcagccctgccccccaacccccaagg

SEQ ID NO: 466 - DNA, 235 bp, Homo sapiens
  CDS 146..235
  sig_peptide 146..217: Von Heijne matrix score 4.59999990463257 seq LLFYVLLFRNLYT/HT
tttatatctttaattgcaaggataaaagaaggggtgcatctcaaaggccatgataaatataaaggatagaaaagttacgttgatggtgtgcccctcgatatctagaagatagcatagtccatgcattctcagaaagatcctatccatgtggtatgtagagatgtgggtttctttttttctacttttttatgtgcttctttttagaaacttatacacacacacacaccacactggg

SEQ ID NO: 467 - DNA, 220 bp, Homo sapiens
  CDS 58..219
  sig_peptide 58..147: Von Heijne matrix score 4.59999990463257 seq VLVVSFVVGGLGC/NX
  misc_feature 218: n=a, g, c or t Oligonucleotide
accacaactcccagggtgctccgcgtcctcgccgctgtcgccgccgcggagacaaagatggctgcgagagtcggcgccttcctcaagaatgcctgggacaaggagccagtgctggtcgtgtccttcgtcgtcgggggcctcggctgtaatdctgcccccattgagcccctacttcaagtactccgtcatgatcaacaaggccacgccctacaactacnac

SEQ ID NO: 468 - DNA, 462 bp, Homo sapiens
  CDS 154..462
  sig_peptide 154..222: Von Heijne matrix score 4.59999990463257 seq WTCVAPVYPACSG/RR
gactgcagccgcgagctcctggaggcggcgggatggaggcggcggccgagcctggaaacctggccggcgtcaggcacatcatcctggtcctctcaggaaaggggggcgttgggaaaagcaccatctccacggagctggccctggcactgcgccatgcaggcaagaaggtgggaatcctggatgtggacctgtgtggccccagtataccccgcatgctcggggcgcagggcardrgctgtksaccagtgsgrrccgcggctgggcamcsgtcttcctggaccgggabcagagcatctcgctcatgtctgtgggcttcctgctggagaagccggacgaggccgtggtgtggagaggccccaagaaaaacgcgctgataaagcagtwkgtgtccgacgtggcctggggggagctggactacctggtggtgacacgccccggggacctccgatgagcacatggcca

SEQ ID NO: 469 - DNA, 438 bp, Homo sapiens
  CDS 391..438
  sig_peptide 391..432: Von Heijne matrix score 4.59999990463257 seq FLFFFGNSPCCGA/TG
tatagtttcagttatgacatgagcacaaacatcatgatttctgttctttttaatgcactcagactggctaagaatatgttctgtgttggtgaatattccatatgtatttgaaaataatatatactctgctcttgttaggttctagaaatgtcaattacctcaaattctctgagagtgcagctcagttcttctatatccttactggtttctgcctacttgctctgtcagttactgagcaaaaagtagcaaagtctgcagctgtaatacatttgtttatttctctcatttttgttagtatttgcttcatgtactttgaagctrtgttgttagcatgcatacacataggatgattatggcttcttggaaaattgacccctttagcattatgtaatgttcctctttttctttggtaacagtccatgttgtggagccacaggg

SEQ ID NO: 470 - DNA, 131 bp, Homo sapiens
  CDS 11..130
  sig_peptide 11..85: Von Heijne matrix score 4.59999990463257 seq SLSLSLSASLIIS/PS
atcttttcacatgggcctctcccaccatcgggtctcagccccatcttctctctctctctctctctcggcctccctcattatttctccctctccctccgcctctccatctctccttsctccccctbcccggg

SEQ ID NO: 471 - DNA, 211 bp, Homo sapiens
  CDS 115..210
  sig_peptide 115..183: Von Heijne matrix score 4.5 seq LSMLLRLVSNSRP/PV
tggcgcgatcttggctcaccgcaccttccgcctcccgggttcgagcgcttctcctgcctcagcctcccgattagcggggatgacagggagtcacccccacgcctggcttggctgatgtttgtgtttttagtaggcacgccgtgtctctccatgttgctcaggctggtctccaactcccgacctcctgtgatgcgcccacctcggcctgggg

SEQ ID NO: 472 - DNA, 150 bp, Homo sapiens
  CDS 25..150
  sig_peptide 25..123: Von Heijne matrix score 4.5 seq VTITILFLIVSMA/LK
ctttattgagggatactttactctatgaaattcactcattttaagtgtacaattcggttattattactatatttacagaatcctgtaaccatcacaattttatttttaatcgtttccatggccctgaaaataaaccacatacccaagggg

SEQ ID NO: 473 - DNA, 352 bp, Homo sapiens
  CDS 227..352
  sig_peptide 227..268: Von Heijne matrix score 4.5 seq SCMSLFPCCPAQS/KN
tatttgattaaaaaagactcttcttgttttctgttttgtctgagttttcattatacccacttctcaactaccccatcccamgggtagaagtttttaaaatttgcatatttaamattcattttcgamttatctgaaattaatcaatatctctactgtagtcttggataatgccaagagtttaaaatgctataatccaaacacctgtttggactcaatatgtcattttatgtcttgtatgtcacttttcccctgttgccctgctcagagtaagaattatatgttattattattcattattttacttccaactcaatttttatattcaaaattagttacaatttgctgttgtttt

SEQ ID NO: 474 - DNA, 141 bp, Homo sapiens
  CDS 64..141
  sig_peptide 64..105: Von Heijne matrix score 4.5 seq LVCCTINSSFALG/IS
  misc_feature 38: n=a, g, c or t Oligonucleotide
tactttaagttctagggtacgtctgcacaacgtsrggntttgatacataggtatatatgtgccatgttggtttgctgcaccatcaactcatcatttgcattaggtatttctcgtaatgctatccctctgccagcccctggg

SEQ ID NO: 475 - DNA, 300 bp, Homo sapiens
  CDS 92..298
  sig_peptide 92..250: Von Heijne matrix score 4.5 seq ALYVICQFILIRS/GV
cagattaagagatggagaaaggtgtagggmtgattctttttttggtgagacctcgcataactatcataaatttgacagtgagtatgagagaatgggacgtggtcctggccccttacaagagagatctctctttgagamaaagagaggcgctcctccaagtagcaatattgaagacttccatggactcttaccgaaggttatccccatctgtgctctatatgtgatttgccagttcattctaataaggagtggagtcaacatatcaatggagcaagtcacagtcgtcgatgccagtctggg

SEQ ID NO: 476 - DNA, 232 bp, Homo sapiens
  CDS 112..231
  sig_peptide 112..150: Von Heijne matrix score 4.5 seq MLYCVVVVHSVCC/AV
ttttaggggggtttggttcgtttttgaactgtatacagatgaaattatacagaatgctttttttttggtatatggcctttttcactctgtagtgtatttgtgagattcatcatgttgtattgtgtagttgtggttcattctgtttgctgtgcagtatactattttgtgattattcatacaatagaacatattacatatttatgtatccattctaccattctactgtgtgtgg

SEQ ID NO: 477 - DNA, 236 bp, Homo sapiens
  CDS 124..234
  sig_peptide 124..201: Von Heijne matrix score 4.5 seq VFXSLFLIQLLIS/FS
  misc_feature 171: n=a, g, c or t Oligonucleotide
aagtggcagcbtcagcacccagggctgtggtaggtcacagtctctgggykggtctcagtgtccaacactgtagctggtgcctgccaggttcccagtggttggggtcaccaggtctgaagagagatgtgctggytgcgggyatggggccagatcctcctgccagttttccbntccctctttctcatccaattgcttatcagcttctcagagaatggttttatccacagccccatggg

SEQ ID NO: 478 - DNA, 201 bp, Homo sapiens
  CDS 138..200
  sig_peptide 138..179: Von Heijne matrix score 4.5 seq CGLXILCGPWLHA/AP
tctacatcacaggtkkatcagtgaaatatgtggtaagatgtacaaataagatgtgccccaccaccagaatgatcagttctgtgaggacacgtccgtgactgtaccctctttcagaagtgctatcrattaatgtggttatgtgtggcctgakkatcctctgtgggccttggctccatgcagcacctccatccccgccgcggg

SEQ ID NO: 479 - DNA, 151 bp, Homo sapiens
  CDS 25..150
  sig_peptide 25..123: Von Heijne matrix score 4.5 seq SISLLLMLXXYWS/CW
acatagcattttatgkactagaaaatgttccatggaagggttatggccatgggtkatttaaccaaacatttaaatctaaacatttctatctcactgttgcttatgctgwwdgwatattggtcttgttggataaaatcacccccgsccatgg

SEQ ID NO: 480 - DNA, 511 bp, Homo sapiens
  CDS 116..511
  sig_peptide 116..499: Von Heijne matrix score 4.5 seq LALHHLSSGHSSG/WT
  misc_feature 150: n=a, g, c or t Oligonucleotide
gctcgcatcatggcggctgagtgggcttctcgtttctggctttgggctacgctgctgattcctgcggccgcggtctacgaagaccaagtgggcaagtttgattggagacagcaatatgttgggaaggtcaagtttgctccsttggaaatnttcccctggatccaagaagttggttgtagccacagagaagaatgtgattgcagcattaaattcccgaactggggagatcttgtggcgccatgttgacaagggcacggcagaaggggctgtggatgccatgctgctgcacggacaggatgtgatcactgtgtccaatggaggccgaatcatgcgttcctgggagactaacatcgggggcctgaactgggagataaccctggacagtggcagtttccaggcacttgggctggttggcctgcaggagtctgtaaggtacatcgcagtcctgaagaagactacacttgccctccatcacctctccagtgggcactcaagtgggtggacatctcca

SEQ ID NO: 481 - DNA, 429 bp, Homo sapiens
  CDS 212..427
  sig_peptide 212..382: Von Heijne matrix score 4.5 seq IWVRFNFLASSQA/CS
aggagagggaatttgttttaaaagagagaaagacattgagactgtgtaaaggggatgttgcaaccttttaaaatctgtgatctcagaccaaattatacaatataatctcagtaggtgccagtagtagggaaaagtgtcagccctcgtgtctggcactaagtaccacccaccccaaccccagtgatgggagcctctaaatgactgagatttaatgtctactacctatttgaatgaggacttgaagaagaaattcagtgcagtkatagagcaggtgctttttgcacacttatccccactacatgtgtggctccagctcaggtctctctgtgagtrtttgacctgcatctgggttagattcaattttttagcctcaagccaagcatgctccaaatgcaactcctcgtttctcatcatgtcatcctcttcacc

SEQ ID NO: 482 - DNA, 385 bp, Homo sapiens
  CDS 145..384
  sig_peptide 145..261: Von Heijne matrix score 4.5 seq LIILDLLVPVIGL/IT
tacacgtacagctcagcctttctgttagctgcaacttcagtgttggtgaattattatgcttctttgcacattgacttctatggtgcctacaacacgtcagcttgtggaattgagctgcttcctcgaaaaggtccctcgctgtggatggcacttatcgttctacagctaacatttggaattggatacgttacactactccagattcattccatctattcacaattaattattttggatctcttggttcctgtaataggcttaatcacagagctaccattacacatcagagagactttactgtttacttcttccttgattctcacattaaatacagtgtttgtcctggcagtgaaactgaartggttttattattccacacgatatg

SEQ ID NO: 483 - DNA, 202 bp, Homo sapiens
  CDS 39..200
  sig_peptide 39..110: Von Heijne matrix score 4.5 seq XVAXFLLTFYVIS/QV
catattaatgaaaagtgccataaactgaaaaaccaaacatgagggtagcaggtgctgcaaarttggtggtarctgtggcartgtttttactgacattttatgttatttctcaagtatttgaaataaaaatggatgcaagtttaggaaatctatttgcaagatcagcattggacacagctgcacgttctacaaagcctccggg

SEQ ID NO: 484 - DNA, 310 bp, Homo sapiens
  CDS 148..309
  sig_peptide 148..192: Von Heijne matrix score 4.5 seq TLVFLSTRQVLQC/QP
gcggggctggaggcggtggctgcggttgcgggaccggcactatgctgggccttcctaccacttatgtgtggcttggtagtggcctagggtctctcctccctgctgaagtccctctcctgcaggtggccgtctgcccggcccagcaccatgcacacgcttgtgttcttgagcacacggcaggtgctgcagtgccagccagctgcctgccaggccctgcccctgctgccacgcgaactcttccccctgctgttcaaggtggccttcatgghcaagaagacagtggtactgcgcgakttggtacacacgcggg

SEQ ID NO: 485 - DNA, 420 bp, Homo sapiens
  CDS 372..419
  sig_peptide 372..413: Von Heijne matrix score 4.5 seq TVVISCLVGECGS/WK
agccggtggcagcacagccaggacagccatttcctcagcagccttcggtaaaggcaacagattctgacggtaactgtgtatcagttggaattactgcactaactttgagggccatactcaaggactccaataataaccaagtcaatggccttagtggaaatacaacaattccgtttagcagctgttgggccaactacacagaccttactccccttagaacaggaaaaaattataagattgaatttatactggataatgttgttggggtagaatccagaactttcagcctgctggcagagtctgtctctagcagtggcagcagcagcagcagcmacagcaaagcatcaactgtgggtacatatgcccagataatgactgtmgtaattagctgtctggttggagaatgtggctcttggaaat

SEQ ID NO: 486 - DNA, 226 bp, Homo sapiens
  CDS 10..225
  sig_peptide 10..150: Von Heijne matrix score 4.5 seq PIFGLLVPSQIFS/SL
caaccatacatgtgcacactcacagacacacacactcacgtccaagtgcacaagtcaaaaccttgccagctcctctcccctcctccaccarsccatggtcctcttcttctccctatctttggccttcttgtgccctctcagattttcagctctcttctcaattctctacatctgggcctgccttccttcccaaagatgccactcatgattttcctcccccgctggg

SEQ ID NO: 487 - DNA, 454 bp, Homo sapiens
  CDS 221..454
  sig_peptide 221..409: Von Heijne matrix score 4.5 seq QILXSTLAMKIHS/QQ
agaaaatggaggcgaatctgtatttccagttaactgctcagaagagagatgctgaagagctgtagtcgtgcatccttctcaccctccgttagaaagcctcctctcatcctcagaagactactgtcagaggatgtaggvatggacatcccctttgaagagggcgtgctgagtcccagtgctgcagacatgaggcctgaacctcctaattctctggatcttaatgacactcatcctcggagaatcaagctcacagccccaaatatcaatctttctctggaccaaagtgaaggatctattctctctgatgataacttggacagtccagatgaaattgacatcaatgtggatgaacttgatacccccgatgaagcagattctttdgagtacactggccatgaagatccacagccaacaaagattctggccaagagtcagagtctattccagaatatac

SEQ ID NO: 488 - DNA, 329 bp, Homo sapiens
  CDS 253..327
  sig_peptide 253..309: Von Heijne matrix score 4.5 seq VLFLLNLFQKIEE/EE
cggctaatgtgatgcctccagctttgttctttttgcttaggattgctttggctatttgggctcctttttgggtccatattaattttaaaacagttttttctggttttgtgaaggatgtcattggtagtttataggaatagcahtgaatctgtagattgctttgggcagtatggccattttaacaatattaattcttcctatctatgaatatggaatgtttttccatgtgtttgtgtcatctctttatacctgatgtataaagaaaagctggtattattcctactcaatctgttccaaaaaattgaggaggaggaactcttccctaatga

SEQ ID NO: 489 - DNA, 414 bp, Homo sapiens
  CDS 149..412
  sig_peptide 149..292: Von Heijne matrix score 4.5 seq LELVATLPDDVQP/GP
  misc_feature 396: n=a, g, c or t Oligonucleotide
gaaagtgcaggcagctgtggaaggcgaagttcaatcccagagtccgccccctgaattggggcctttccggaggaggaagctctgaaaaacaggggggcccagtgccattccgcagggaattgtcgcttgcgttcagctgttctacacaatggactcagtacctgccactgtgccttctatcgccgctaccccgggggacccggaacttgtgggacccttgtctgtgctctacgcagccttcatagccaagctgctggagctagttgctacattgcctgatgatgttcagcctgggcctgatttttatggrstgscatggaaactgtatttatcactgccttcttgggaatkgttcgtttgccattttcttatggagactgtccttgttgtgaaggntagagtatatcwagtcac

SEQ ID NO: 490 - DNA, 185 bp, Homo sapiens
  CDS 69..185
  sig_peptide 69..122: Von Heijne matrix score 4.5 seq AVWASVASPASIC/CG
agttccggcctccaaggggcgggcagaagttggaaacatgcggctgtcggtcgctgcagcgatctcccatggccgcgtatttcgccgtatgggcctcggtcgcgagtcccgcatccatctgttgcggramytggctcacagggctggtgcggcacgaacgcatcgaggcaccatgggcgcgtggg

SEQ ID NO: 491 - DNA, 348 bp, Homo sapiens
  CDS 247..348
  sig_peptide 247..333: Von Heijne matrix score 4.5 seq ILLILQLLKXSLK/KC
  misc_feature 323..324: n=a, g, c or t Oligonucleotide
ttatgtttaaaaggtcacaagtctagaataactgaattgggaattggaaataccttaattctataatttgtatctaaaattaggttttcccttttaagttgttaattttctatggkttgtgctgcatgctttcacttttattagtacttacagccaaagagatgggcaaatgtctagaaaaattaatgttttgattcaggaatttgtgcctagtgatggcctccaatagagaattttccagagagaatgaagactcagtttctaagttggggcaaatttagtttttgttttggtattcttcttatattacagctattaaaabnntctcttaaaaaatgccggcacggg

SEQ ID NO: 492 - DNA, 126 bp, Homo sapiens
  CDS 5..124
  sig_peptide 5..79: Von Heijne matrix score 4.5 seq LRFILPSSWDCRC/AP
ctacatgcttcctgctgtggctgtctcggaacccgtggtcctccgcttcattctgccgagttcctgggattgcaggtgcgcgccgccactcctgactggtttttgtattttttggktggagacggg

SEQ ID NO: 493 - DNA, 300 bp, Homo sapiens
  CDS 119..298
  sig_peptide 119..217: Von Heijne matrix score 4.40000009536743 seq WLLMVAPRLPAGA/RD
acactgcctgcctggtgcagcccatgtgacgggtcgagctccgggccctgctgtccctggccgggctatcccagtggcttcaggcaccttctccagacctacccagaaagatgcccggatggatcctgcagctccgtggcttttctgggaagcagcggcccctgctctcaagagaccctggctcctgatggtggccccaaggttgccagctggtgctagggactcaggacagtttcccagaaaaggccaagcgggcagcccctccaggggccgggtgaggaagctggggggtgcggtggg

SEQ ID NO: 494 - DNA, 295 bp, Homo sapiens
  CDS 182..295
  sig_peptide 182..274: Von Heijne matrix score 4.40000009536743 seq SRLXALLSPYAFT/LX
tttatacacacacacacacacacactcatattcattacatgtgtgtactttctggttgcttcagtaggacttttctaggcttctttggactatgtgtgatattttacttcagggactgaatttcacaactgcctactatgcaactttgtgattttcttgaaagcacaaktactatatataaatgaaaatgtccaccccctccccgctttctaaaaaagtgctcagaaaccaggtctcaagattgrttgcgttgctttccccatacgctttcactctgsctcgtcttgcctcaggg

SEQ ID NO: 495 - DNA, 244 bp, Homo sapiens
  CDS 70..243
  sig_peptide 70..114: Von Heijne matrix score 4.40000009536743 seq RFLLLYATQQGQA/KA
ggaagtcgcgttgtgcaggttcgtgcccggctggcgcggcgtggtttcactgttacatgccttgaagtgatgaggaggtttctgttactatatgctacacagcagggacaggcaaaggccatcgcagaagaaatgtgtragcaagctgtggtacatggattttctgcagatcttcactgtattagtgaatccgataaggtctcggtgattcagaatacacctacttttgcaacgggggggcggg

SEQ ID NO: 496 - DNA, 215 bp, Homo sapiens
  CDS 91..213
  sig_peptide 91..171: Von Heijne matrix score 4.40000009536743 seq FVNLNLCFAYTFA/LY
atttaagtccagagagcaaggtgattgcagtttctttgttcggtttgcttattttttactgcttatttctgtgtgcataaattcagcgacatgctaatagacatatggtcaatggtgcttagagaaaatctgtttgtaaacctgaatctctgttttgcctacacatttgcattgtattcctgccctgctccaactcgttgtcctagaccatccag

SEQ ID NO: 497 - DNA, 255 bp, Homo sapiens
  CDS 36..254
  sig_peptide 36..89: Von Heijne matrix score 4.40000009536743 seq WFPLSCSPSLPLS/IP
cttttggggttcgctgtttcttccctctctgctggatgctgtcttgcccctggtttcccctatcctgttctccctccttgcctctgagcatcccagactgcctgcctgccttcctctggccgctggggataccctggcctgatggagagggtctaagaccttcccgtcttctccggacacgggaaaacattacccctctctctttattcgctatgctgagtggcagggagggtgccccgctcctggtccccctgg

SEQ ID NO: 498 - DNA, 82 bp, Homo sapiens
  CDS 23..82
  sig_peptide 23..61: Von Heijne matrix score 4.40000009536743 seq MVVVSFLASSSLP/AE
ctttttcgtctgggctgccaacatggtagttgtttcgtttcttgcctcctcttccttgccggcggagacccctaagcaaggg

SEQ ID NO: 499 - DNA, 474 bp, Homo sapiens
  CDS 39..473
  sig_peptide 39..359: Von Heijne matrix score 4.40000009536743 seq IIILFVVITSRRG/SP
ttcctggaccgcgctggaagccctggcggcggcggcccatggggcscttggcgctgcycgcctggctgcagcccaggtataggaagaatgcgtatcttttcatctattacttaatccagttctgtggccastcttggatatttgcaaatatgacagtcagattcttttcatttggaaaagattcaatggttgacactttttatgctattggacttgtgatgcgactttgccaatccgtatctctcctggaactgctgcacatatatgttggcattgagtcaaaccatcttctcccaaggtttttgcagctcacagaaagaataatcatcctttttgtggtgatcaccagtcgaagaggaagtccaacgagaaatatgtggtgtgtgtgttattcgtctttggatctatggatatggttargtacacttatagcatgktdatcagtcataggaatatcctatgctgtcttgacat

SEQ ID NO: 500 - DNA, 241 bp, Homo sapiens
  CDS 177..239
  sig_peptide 177..230: Von Heijne matrix score 4.40000009536743 seq SLTLTALLVPSRV/QP
cttcactcatggggagagcatttctacctgacaccctcccatttctgttttccttacccagatctaccttctgagatatcatccttcttcagggagataaggaaaaaaagccacagggtcccggagagccaggggaatggtgagtgtttcctgtctccattactggctgtaacaggatggacacattcccttctcttaccctgactgccttattggtgcctagtagagttcagccccaggg

SEQ ID NO: 501 - DNA, 430 bp, Homo sapiens
  CDS 178..429
  sig_peptide 178..237: Von Heijne matrix score 4.40000009536743 seq LRYVASAVFGVIG/SQ
  misc_feature 17: n=a, g, c or t Oligonucleotide
gaggtgagtcctggrrntgcgtggttggggcggagagcattatctgcggctccgattttgcagattctggctgaggcgttcgtgatgtcagcagcagccgagacgggcgtgttaaaggccggttgctagggctgggggaactcagattgcttcacctgtggtatcagacatcacaacatggggctcaccaagcagtacctacgctatgttgctagtgcggtctttggcgttatcggcagccaaaaaggtaatattgtctttgtgacacttcgtggtgagaaaggacgttatgtggcagtaccagcttgtgaacacgttttcatcwgggacttaaggaaaggagagaagattcttatccttcaggggcttaaacaagaagttacttgcttatgcccctccccagatgggctacacttagctgttgggtatg

SEQ ID NO: 502 - DNA, 413 bp, Homo sapiens
  CDS 333..413
  sig_peptide 333..404: Von Heijne matrix score 4.40000009536743 seq VFFSVLYVQQGLS/SQ
  misc_feature 7,359: n=a, g, c or t Oligonucleotide
agggasnggcagtgatcacgcaagccggagcggcgggctgacgttggacgagctgccaggtagctgaaagcaggcagccaggcagccgagacacttcccagcgattccagcctgggctccgcagaagcctcgctgaatcccagccagctggttctaaccttccagaatcgcaatcccttctccccacagccagccctcgccgagcaagcagcaggatgtttgcagtgtcgcgcccagggctctgagactgagcctgccatccactcgcacgcctttctttcagggcttttcggctgttggctacactgatgtgacccccctccctttttggaatgatggggatctttttggtgtatgtnggatttgttttcttttccgttttatatgtacaacaagggctttcttctcaagca

SEQ ID NO: 503 - DNA, 167 bp, Homo sapiens
  CDS 26..166
  sig_peptide 26..91: Von Heijne matrix score 4.40000009536743 seq WVLDPALLLTCLT/FP
gaatcggacaacttaaagtctcgatatgagcctcggattgcattcgaactcctgggttctagacccagctctgctactaacttgtctgaccttccccatttataaactgttgtgggtgagaggtgggacwaggwgaactctrwgrgcvctgcactcggcgcggacgg

SEQ ID NO: 504 - DNA, 420 bp, Homo sapiens
  CDS 217..420
  sig_peptide 217..396: Von Heijne matrix score 4.40000009536743 seq MWVXCXFCFVLFC/FE
  misc_feature 47..48,368..369,373: n=a, g, c or t Oligonucleotide
ggktccgctccctggggcgcacgtcagtcaggaggcggaagcgcagnngaggcgggaaggttgtagtgccgcgagttgagctcctcttgcctaagtggtcgcgccccctttaagagcagcgattgtaaggagaggcggtcccggtgtcctcgggtcccaggtgattgtgaagtgctgaccaattgccactggacatacttgaaacaaaataggaaaatggcagcaaactcttcaggacaaggttttcaaaacaaaaatagagttgcaatcttggcagaactgacaaagagaaaagaaaactacttatgcagaaccagtcttcaacaaatcatcctggarctaggtattgacactataatgtgggtttnntgtntgttttgttttgttttgttttgttttgagacggagtctcgccctgtc

SEQ ID NO: 505 - DNA, 457 bp, Homo sapiens
  CDS 43..456
  sig_peptide 43..147: Von Heijne matrix score 4.40000009536743 seq PAPLLFLPPAAPG/GE
  misc_feature 416..417: n=a, g, c or t Oligonucleotide
gtagtcggatagttggcgggtggttgagtggaagcggtcgccatgtccgcggggagcgcgacacatcctggagctggcgggcgccgcagcaaatgggaccaaccagctccagccccacttctcttcctcccgccagcggccccaggtggggaggtcaccagcagtgggggaagtcctggggscaccacagctgctccttcaggagccttggatgctgctgctgctgtggctgccaagattaatgccatgctcatggcaaaagggaagctgaaaccaactcagratgcttctgagaagcttcaggctcctggcaaaggcctaactagcaataaaagcaaggatgacctggtggtagctgaagtagaaattaatgatgtgcctctcacatgtaggaacttgctgactcgaggacaganncaagacgagatcagccgacttagtggggctgcagtatcaa

SEQ ID NO: 506 - DNA, 315 bp, Homo sapiens
  CDS 141..314
  sig_peptide 141..203: Von Heijne matrix score 4.40000009536743 seq IRAVCLSGGSCWG/GV
ctctttctgtcttgatttttctgtgtgtctctctgcgtcttgtctatttgttttctctctttcttctctgtggccctcccctttgtctcttcctttctgttttctcctgtagttcctcctcttctctcccctgattgctcatgagtccccttgatcaggctgtaatacgtgctgtgtgtctcagtggaggttcctgctggggaggagtccgttgtcttgtgcgtgggggcccgaacataggccctgcagcccagctgcttgggggcattccactctgctggccaccagctgtgactgcaggtgaagtgaaactgc

SEQ ID NO: 507 - DNA, 208 bp, Homo sapiens
  CDS 152..208
  sig_peptide 152..196: Von Heijne matrix score 4.40000009536743 seq SFHFIXFLPFPWA/EX
  misc_feature 201..202: n=a, g, c or t Oligonucleotide
agaatcgcgcaggcgcaattgtgccctggttcgccaagatgtcgttcccaaagtataagccgtcgagcctgcgcactctgcctgagaccctcgacccagcccggctcctgtcctcctgtattcctgcagtccttttaaggaagaaaagtgaatgaactcatttcattttatttssttcctccctttcccctgggctgaawnngcgcag

SEQ ID NO: 508 - DNA, 169 bp, Homo sapiens
  CDS 65..169
  sig_peptide 65..151: Von Heijne matrix score 4.40000009536743 seq LLSTHTWTDTALA/FS
atacagacacccagrsaggaccctgaacacacagacaggcacagggacccctgtgcccacagggatgggctggcactcacatagttcccaaggcgtgcawgcaatgcctctgctgctgtccacacacacctggacagacacagccctggcattcagcacacacacacac

SEQ ID NO: 509 - DNA, 118 bp, Homo sapiens
  CDS 12..116
  sig_peptide 12..77: Von Heijne matrix score 4.40000009536743 seq WFLRSWTWPQTAG/RV
caattcaagtcatgcrggctgtgagaaacgcggggtcgtggttcctgcggtcctggacttggccccagacagccggcagggtcgtggccagarsgccggccgggaccatctgcacagg

SEQ ID NO: 510 - DNA, 402 bp, Homo sapiens
  CDS 334..402
  sig_peptide 334..378: Von Heijne matrix score 4.40000009536743 seq ALFILVSISLFYA/LF
cctcctcagcctcctcagtaccattctgttaccaccattggtcctgcattctgagtttgccacctggcacgtgcccttcaaatgtctccactgcgtctttgcctttcccttttctgttgcgtgccatcattccgattccgattttaacagcaacctgctgatttcctgccatagtttcctactttccattctgagcccctttaatccacttatacaatataactactccctgaattatttggtcataccacttgtatctgccgaacccctattcctcccctggggtacgttttccactaaacacacacagggaaatgccacccaaatagctctatgtgtgccttgttcattcttgtttccatttctttgttttatgcactttttatctctccatccatacaa

SEQ ID NO: 511 - DNA, 343 bp, Homo sapiens
  CDS 159..341
  sig_peptide 159..317: Von Heijne matrix score 4.40000009536743 seq NLVLYFLVHLLFS/LS
cagaggcttttatttgcataaatgtcggaccgtcttagctctcttgtgaaaggaactttttgccatattatagtggctcaccttacctcctggaatgcattctggcctcaagtctgtacctagcattgatagaggaagcccagcctggtgtgcacagcatgtacctggtgtgcacaacatgcacctggtgtgtattttctgaaatgtttgttcatggattaaacatcactcagctcgtgctgagccagctggattactttttccattccaatctgacaaacttggtcttgtatttcttagtccatttacttttttcccttagcctgtttatgccgctgacggg

SEQ ID NO: 512 - DNA, 420 bp, Homo sapiens
  CDS 7..420
  sig_peptide 7..240: Von Heijne matrix score 4.40000009536743 seq FWWWLGSLXVTWL/IH
  misc_feature 93,100,137..138: n=a, g, c or t Oligonucleotide
taagtgatgaagctgaaattatacctatgtatattaggtccctggggctgcaakrkcaaagtaccactaattgggtttcttaaaagaataaanhtatatnwtctcacagttctgaaacctagdagtctgaratcaanntcagcagggttggttccttctgaggactctaaaaaagaatctgtttcatgcctctctcctaggttctggtggtggctgggaagcctgaktgttacttggcttatacatgcatcactccagtctctgtctcctttttctcatgccattttctcatgtgtctctgtgttttcctttgcttataaggataccagtcatattgaattagggcctgctctaataacctcatctcaattacctctgcaaggaaccaatttccaaataatgtcacactcacatgtagca

SEQ ID NO: 513 - DNA, 324 bp, Homo sapiens
  CDS 219..323
  sig_peptide 219..317: Von Heijne matrix score 4.40000009536743 seq LKLLFLILILIAG/YR
aaaacattctgaatagtttatttgtcttgacggaaagtaaaaagaacaaacttgttttatacaaaatcagatgctccaaatggtcagttgatgatgataccaatcaaagaaaactaaggaggaagaaaaagaaaacaggaaagagaggaggcaacaggaaaatcggccttcgtccttcagtctacgcttgaaattgccagggatggataaatctgaagatgaatgaaaaaaagaaactactgggaacggaacagaaacaaaaaaaaaggatgggaaatctgaagctgctatttcttattctgatcttaatagcaggatacaggg

SEQ ID NO: 514 - DNA, 303 bp, Homo sapiens
  CDS 212..301
  sig_peptide 212..292: Von Heijne matrix score 4.40000009536743 seq SALMLPLGCAVRT/RM
tttccctcactctctgcctcccccatcgcaccccacaggagggtttccctcactctctgcctcccccatcgcaacccacaggagggtttccctcactctgcctcctccawcgcacccccakggaggtgttttccctcactggttctgttggtggcggtggcagcaatccgagtcacatggcaccagagtatgtcacgggtggcggatctgaatggggctgcagagcctcacacttccagtgtcttgcagcccttctgccctgatgcttcccttgggatgtgctgtccgcacgcgcatgcttga

SEQ ID NO: 515 - DNA, 455 bp, Homo sapiens
  CDS 342..455
  sig_peptide 342..434: Von Heijne matrix score 4.40000009536743 seq LTTLESLAGSVXS/EQ
tcatatctggwaatggcaaacagggatgaaaatcgattatgttttggagactccttttggacatgtatcagtgtgttgatttgcacaaaccaataaaagccctacattttttggaaatggatccctagatttcaagcatgtataatcactcaaagtggatatgatcacaggcattcttctcttgagctcagcaaaactatgcctaccaacaccgaagagaagtcaaagatttttatgaaaaaaaattgcagatgatgttggtgagataataggatatgagcaatgaacccttgggtggggttccagggcacttaaattgcctcgtgtcttgagtccttaagatggactcaaacaaaaaattagtattatcaataacaggtaatactgtgtggattctaacaacattagaatcattagctggcagtgtcaamtctgaacaagatttgtcagcttat

SEQ ID NO: 516 - DNA, 360 bp, Homo sapiens
  CDS 196..360
  sig_peptide 196..336: Von Heijne matrix score 4.40000009536743 seq SFXXCLFLXLXXS/EM
  misc_feature 330..332: n=a, g, c or t Oligonucleotide
aagagcgttgggcagatatagtctgtagatatttttgaaacgtctttgggtttgtcccatttggggtttgctcagcttcttgaatctgtaggttttggggatcccccamcctgcaaatttggtgatatttttgctcttatttctkcaagtgaacttgaaatcccaccctgttggttttctccttctaagactctgatgacgtgtatgttagcctgtaggtgtagtctcamgggtccccaagattttcgtttctgctctgtcttttctctgttgctcaagttgggtaatttctatttttcttttwctdtctgtctwtttctwdtactdwynnnttctgagatggagtcmcactctttcagc

SEQ ID NO: 517 - DNA, 453 bp, Homo sapiens
  CDS 113..451
  sig_peptide 113..307: Von Heijne matrix score 4.40000009536743 seq FIEAALLIHGSAC/VY
attttcctgggcgggaacagcaaaatggcgccagaactagtggcgggctgaggacgccgtacccctcggaaggcagccctgcggtccctttgccgcccgttccctcccggacatggaggacgtggaggcgcgcttcgcccacctcttgcagcccatccgcgacctcaccaagaactgggaggtggacgtggcggcccagctgggcgagtatctggaggagctggatcagatctgcatttcttttgacgaaggcaagaccacaatgaacttcattgaggcagcgttgttgatccatggctctgcctgcgtctacagtaagaaggtggaatacctctactcactcgtctaccaggcccttgatttcatctctggaaagaggcgggccaagcagctctcttcggtgcaggaggacagggccaatggggttgcagctccggggtccccaggaggcag

SEQ ID NO: 518 - DNA, 245 bp, Homo sapiens
  CDS 185..244
  sig_peptide 185..229: Von Heijne matrix score 4.40000009536743 seq VSYLILTLLHVQT/AV
agttttcttcagaacagaggctgagctcgaagcgccgggcagtacagtgagggagagccgagggaaccagcgcggtgcctagcggaactccagggctggaatcccgagacacaagtgcatctgctagctgttagcacttggcagacggagttctcctctagggtagttctaactttgggtaataatgtttgtcagctacctgatattaacattgctccacgttcaaacagcagtgttagcaagac

SEQ ID NO: 519 - DNA, 275 bp, Homo sapiens
  CDS 96..275
  sig_peptide 96..170: Von Heijne matrix score 4.40000009536743 seq IFLLYFKFWGTCA/ER
ttgttttttagaaaaatgaataatttctttttatattattctgttacattttttccccacttaatagaacgtccagaaaatctttgcatctcagaatgcctgaagctgccttgttcttgttttttttattcatttttttattatactttaagttctggggtacatgtgcagaacgtgcaggtttgttacataggtatactcgtgccatggaggtttgctgcacccatcaaccatcatctacattaggtatttctcctaatgctctccttccccta

SEQ ID NO: 520 - DNA, 182 bp, Homo sapiens
  CDS 91..180
  sig_peptide 91..159: Von Heijne matrix score 4.40000009536743 seq LCMHLSIHPXXCA/CI
gtctgagcggcacagacgagatctcgatcgaaggcgagatggcggacgtgctagatcttcacgaggctgggggcgaagatttcgccatggatgaggatggggacgagagcatccccgcctctgtgcatgcatctgtccatccatcccckymtctgtgcatgcatctgtccatccatccaggg

SEQ ID NO: 521 - DNA, 218 bp, Homo sapiens
  CDS 104..217
  sig_peptide 104..211: Von Heijne matrix score 4.40000009536743 seq XVCVCVCVCVCVC/VC
  misc_feature 145,151,174: n=a, g, c or t Oligonucleotide
atttatgtaggcaggtggatgccaactgccagtgcagggtggcataagttagcgttccaaagttaagctatggtgcattccaaatccattcacacttaggagaatgtacccaagagtgtggggatgttttcaattactgcatttncttcanbgaacaagaacsacaggtaagtnwgtgtgtgtgtgtgtgtgtgtgtgtgtgtgtgtgtgtgtgtgtg

SEQ ID NO: 522 - DNA, 313 bp, Homo sapiens
  CDS 12..311
  sig_peptide 12..53: Von Heijne matrix score 4.40000009536743 seq AAVVLAATRLLRG/SG
ggagacgcaagatggcggctgtggtgctggcggcgacgcggttgctgcggggctcgggttcttggggctgttcgcggctgaggtttggacctcctgcgtacagacggtttagtagtggtggtgcctatcccaacatccccctctcttctcccttacctggagtacccaagcctgtttttgctacagttgatggacaggaaaagtttgaaaccaaagtaaccacattggataatgggcttcgcgtggcatctcagaataagtttggacagttttgtacagtaggaattcttatcaattcaggatcgagatatga

SEQ ID NO: 523 - DNA, 502 bp, Homo sapiens
  CDS 324..500
  sig_peptide 324..398: Von Heijne matrix score 4.30000019073486 seq ALYLSLNLYFANS/LY
  misc_feature 284,469..470,472: n=a, g, c or t Oligonucleotide
gtctaggctcttcaagttaggattcatatctatgacatgtgctgtacagtgcttctactgtgaggtagtctcccagacagaaaccacatgggccttcaggcatagatggtcagtaaataattactttacagtggtgtcatttcttaggagacmcagagtragaccttaagtgagatcttacctacctcctcccatccaatctatccatacaaggttggacctaaagcagccttgagcttaataatgatgtgtgttagaacaaggatactgagattagactaagntggttctttaagtcagccgtctctgacaaagggcacacaatgtactgtctgargtgtgtggagaaaatagcaaaagctctttatctcagccttaatttatattttgcaaattcactttattatatgtgtgtgtgttcatacatatacttttatttatktatttatktktatkktttaataaaaanndngtcttattatgttgcccagactggtctcaa

SEQ ID NO: 524 - DNA, 118 bp, Homo sapiens
  CDS 11..118
  sig_peptide 11..97: Von Heijne matrix score 4.30000019073486 seq SAVFLTAVFSSHS/WL
atctttgttgatgtgtcagctccgcaggggtttggggaaacggccgctgagtgaggcgtcggctgtgtttctcaccgcggtcttttcctcccactcttggctggttggaccccgctat

SEQ ID NO: 525 - DNA, 276 bp, Homo sapiens
  CDS 176..274
  sig_peptide 176..268: Von Heijne matrix score 4.30000019073486 seq LTFCLIDLSNVDS/GX
cctgagttctagtttgattgcactgtggtctgagagacagtttgttataatttctgttcttttacgtttgctgaggagagctttacttccaactatgtggtcgattttggaataggtgtggtgcggtgctgaaaaaaatgtatattctgttgatttggggtggagagttctgtagatgtctgttaggtccacttggtgcagagctcagttcaattcctgggtatccttgttaactttctgcctcattgatctgtctaatgttgacagtgggamggg

SEQ ID NO: 526 - DNA, 366 bp, Homo sapiens
  CDS 103..366
  sig_peptide 103..261: Von Heijne matrix score 4.30000019073486 seq LRLTWLVAAGLEG/RV
tcactacttctcccccggactccttggtagtctgttagtgggagatccttgttgccgtcccttcgcctccttcaccgccgcagaccccttcaagttctagtcatggtgagtggggttccctcggggctggggaagagtgcgcgtcccaggggacggcgggcccggaaactactgcctgcacctcgggccgcgcccaggacagctccagactaccccgggcccctccggttaacctggcttgtggcggccgggctggaaggtcgagttcacttggcagacaccagttcgggccggaaaacctggcccgggtgcggccatcagtggaaatggaaagccctcttgatcctagtgagggctttccccgca

SEQ ID NO: 527 - DNA, 428 bp, Homo sapiens
  CDS 316..426
  sig_peptide 316..408: Von Heijne matrix score 4.30000019073486 seq VCSSLRSXRPCWC/DG
catttcctaatctctgcattttccagcaagtaagtggtggtgacttgttgctttcaagtatgttttgtctaaaattcatagatgctgaactgtgtatatttgttgtcaagtttgaaaggtacttgggtttttgggggtgttaggaggtagggtggatgttactattaaatacatttagactttttaaaataagtgtaactgatcatttccaacaaatatttactatgtccatacttgtgctccaaaagacaattctgtcttcctcttgagatacatgtctcggggcccctgtaggtctggtctgagagggtccccatgggtggctgtgtcwgctggcgctttcttggacactcctctgctctcaggactgtgtgtagcagtctgcgctcagyaaggccatgttggtgtgatgggcttcggctcagatg

SEQ ID NO: 528 - DNA, 400 bp, Homo sapiens
  CDS 83..400
  sig_peptide 83..235: Von Heijne matrix score 4.30000019073486 seq STCLLRALSSELC/AP
gacacggaagtagctccgaacaggaagaggacgaaaaaaataaccgtccgcgacgccgagacaaaccggacccgcaaccaccatgaacagcaaaggtcaatatccaacacagccaacctaccctgtgcagcctcctgggaattccagtataccctcagaccttgcatcttcctcaggctccaccctataccgatgctccacctgcctactcagagctctatcgtccgagctttgtgcacccaggggctgccacagtccccaccatgtcagccgcatttcctggaccctctctgtatcttcccatggcccagtctgtggctgttgggcctttaggttccacaatccccatggcttattatccagtcggtcccatctatccamctggctccacagtgctggt

SEQ ID NO: 529 - DNA, 244 bp, Homo sapiens
  CDS 68..244
  sig_peptide 68..133: Von Heijne matrix score 4.30000019073486 seq LFFETGSPSVAQS/GV
cttacagagttaataagcatcaaagaacttactgaaggactttataaattaaataccattatgtagaatggtggtggttagtgcctttatttatttattttttgagacagggtctccctctgtcgcccagtctggagtgcagtggtgtgatctcggcttactgcagcctccgcctcctggattcaagcgattctcttgcctcagcctcctaggtagbdrggattgcagacgtgcgccacccggg

SEQ ID NO: 530 - DNA, 434 bp, Homo sapiens
  CDS 124..432
  sig_peptide 124..195: Von Heijne matrix score 4.30000019073486 seq LXFLGMFLSGMVA/QI
ggsctttggattggawagaggagctgggcaggaggcagggcaaggagaaagctgttcgggggtcttgtctggattttggttgcctcctccaatgttcctctacctctactacaaggatgggtcatgtttgtgtctgkaacarcgtttttctttkcgctcckctttctgggcatgttcctctctggcatggtggctcaaattgatgctaactggaacttcctggattttgcctaccattttacagtatttgtcttctattttggagcctttttattggaagcagcagccacatccctgcatgatttgcattgcaatacaaccataaccrggcagccactcctgagtgataaccagtataacataaacgtagcagcctcaatttttgcctttatgacgacagcttgttatggttgcagtttgggtctggctttacg

SEQ ID NO: 531 - DNA, 406 bp, Homo sapiens
  CDS 284..406
  sig_peptide 284..361: Von Heijne matrix score 4.30000019073486 seq AXYLLVGLFPLKC/HX
  misc_feature 384: n=a, g, c or t Oligonucleotide
taatatatgtmagaatagcagggaccatgtcttctgttcaatatkgtatcctgagcacctagtatttaagtaggtatttcagtaaataatgtaacatatataataaataatattaatatttgttgactaaatgaatttaggtctggaccttgatggcttaatgtctttctaaaaatctacttccatatctaagcctttcttgactactttcgcctttttctgtgaacttaaaagtctttattcattgtttgccggatgctaaacatttacaaaagtaatccttatgtcatctgaaattttctawkttdtkcakattgcktatgcttdatatttgctagttggtcttttccctctaaaatgccacwagagthatttttctaagtnacaaatctcatcatttgtggaa

SEQ ID NO: 532 - DNA, 212 bp, Homo sapiens
  CDS 23..211
  sig_peptide 23..76: Von Heijne matrix score 4.30000019073486 seq LTVTLGRLASACS/HS
gtttccggccgaggctgcggccatggcagcatcttccctgacggtcaccttagggcggctggcgtccgcgtgcagccacagcatcctgagaccttcggggcccggagcagcctccctttggtctgcttctcgaaggttcaattcacagagcacttcatatctaccaggatatgttcvtaaaacatccctgagttcaccaccttggccgaggg

SEQ ID NO: 533 - DNA, 149 bp, Homo sapiens
  CDS 76..147
  sig_peptide 76..129: Von Heijne matrix score 4.30000019073486 seq CICSCLFFSQYLX/XS
tataggtgattataatcaagtgtaggcttcctgaattttgacatccttttagaacttgggtctggaattccagaaatgttaattgctgcttgtatttgttcttgtttgttttttagccagtatttggsyytttctaatccagccgcggg

SEQ ID NO: 534 - DNA, 145 bp, Homo sapiens
  CDS 56..145
  sig_peptide 56..103: Von Heijne matrix score 4.30000019073486 seq WVLSYMWQSASLG/FS
tgggctactcatggywagataagacttacacttctgaaagaggccttagagtttcatgaagtgctgggttctcagctacatgtggcagagtgcatctctgggttttagtaacaggattaaatctmacttgagacctccagcaggc

SEQ ID NO: 535 - DNA, 384 bp, Homo sapiens
  CDS 81..383
  sig_peptide 81..287: Von Heijne matrix score 4.30000019073486 seq GIRLSCVLSHLQA/WD
aaatcctcagcagatttttgttcaagagctgcttccagattggcttctagctgccagtgtgaccttgggcagaaccttcaatgtctgtggggctgtgttttcttatctggcaaatgggaattatgctsttgcctcgggaatgttggaaggtcaaagacagtaagaagtacaaaagctgcagagaatcagtactgcctgcacaagcatgtacaggagagtcccctgtcttatctggagtcagggttctggggatccgcctctcgtgcgtgttatcccatctccaagcctgggactcctgggacaatcagaaggtgtgctacctgggtgcaccctgctttgggaaaaggctgagtccaaccacctggctcactttttgggtgggac

SEQ ID NO: 536 - DNA, 207 bp, Homo sapiens
  CDS 78..206
  sig_peptide 78..119: Von Heijne matrix score 4.30000019073486 seq FAFLAGCSGSCLW/SR
aactttacccagatatactatatgccaaacaatgtttgtcaccagggataccacaacagaaaacaaatacactaaaaatgttcgctttcctggccgggtgcagtggctcatgcctgtggtcccggcacttcgggagactgcggcgggcggctcccttgagcccagagtttgagaccggcctgggtaacatggtggaaccccaatggg

SEQ ID NO: 537 - DNA, 394 bp, Homo sapiens
  CDS 268..393
  sig_peptide 268..318: Von Heijne matrix score 4.30000019073486 seq FLFVPHLISCNWC/EP
ttagcaaatcacagatgaaggtctcattactatatgcagagggtgccataagttacaatccctttgtgcctctggctgctccaacatcacagatgccatcctgaatgctctaggtcagaactgcccacggcttaggtaaacatttcttgtttagctcaaaaaaatcatagaacaaaagtttccttcacccatatttcttccttggaactttggaattttaaggtaggcactgcagacgctttgaaattttaaggtagtcccttttagatgcccacctacttcctttttgtacctcatttgatttcatgtaattggtgtgaaccaaggggtaacaatccccaaattccactacttgctatccatactagaaaaaagaatcaacattttattactt

SEQ ID NO: 538 - DNA, 415 bp, Homo sapiens
  CDS 237..413
  sig_peptide 237..317: Von Heijne matrix score 4.30000019073486 seq LTSVSLXXXXXXG/SV
  misc_feature 308..309,375: n=a, g, c or t Oligonucleotide
gaatcctcgcaaagaattggcaatgtcgttgcctttctctggcggaaggctggcwactaccctttgaatttggaatgtatgtcacacagttctagagtagaatgcaaactcagcactgtcctctttgaaccaaaatgtctccaaaaacaagattctaatttatacttaatatttcccccagaagcccaatcattaaagccacctttccaggaacagaagtgtttttgacactgtgaatgctttggaccagtttccagaatcctcttcaggtagtgcttctcaccagcgtttcccttttdawwwtggbnndcmtaggttcagtccgaatcawkctatctcactggtcaagctcagccttcttcttcctdattcwbnckkywhwtctttcacatgtgacaaaacaaatgcatttgaa

SEQ ID NO: 539 - DNA, 160 bp, Homo sapiens
  CDS 66..158
  sig_peptide 66..107: Von Heijne matrix score 4.30000019073486 seq LTCLCGCFIVLLV/CV
tacattcaaggttagtattgatatgcatgtatttgatcctgtcattgtgttgttagctgtttattatgctgacttgtttgtgtggttgctttatagtgttacttgtctgtgtacttaaatgtgtttttgtagtggctagtaatggccttttctttccttt

SEQ ID NO: 540 - DNA, 327 bp, Homo sapiens
  CDS 207..326
  sig_peptide 207..293: Von Heijne matrix score 4.30000019073486 seq HLSILAFVAIAFG/VL
catttttttcatgtgtttttttggctgcataaatgtcttcttttgagaagtgtctgttcatgtccctcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgccagggg

SEQ ID NO: 541 - DNA, 396 bp, Homo sapiens
  CDS 84..395
  sig_peptide 84..278: Von Heijne matrix score 4.30000019073486 seq FFSRLGATSVXRA/CT
  misc_feature 271,328,344..345,347: n=a, g, c or t Oligonucleotide
cttctgcactcacagccgaaggaaagcagcaggttggggcttcttgtggccaacttcagagcctgtcaccaggaaaggtaagcatgggaggaaggaagatggcgacagatgaagaaaatgtctatggtttagaagagaacgctcagtcccggcaggagtccacgcggaggctcatccttgttgggagaacaggggccgggaagagcgccactgggaacagcatcctgggccagagacggttcttctccaggctgggggccacgtctgtgancagggcctgcaccacggrhagccgcaggtgggacaagtgccacgtggaagtcgtrgndctmggacatvwkcannmngggaagtgtccaagacagatcctggctgtgaggagagaggtcactgcta

SEQ ID NO: 542 - DNA, 247 bp, Homo sapiens
  CDS 8..247
  sig_peptide 8..100: Von Heijne matrix score 4.30000019073486 seq ALALTXTLLPAPG/EH
  misc_feature 78,182,194: n=a, g, c or t Oligonucleotide
atcaataatgcagcttcaagttctggggagaccgcagggggccccccagctggctccccaggccttggctctaactbnkaccctcctcccagccccaggagaacacgattckccratgstcattggccagtttccccwaaaccctccctccgagcacccgggcgccagtcccaggcggwmrnggacgggctggnraccccaaagctgggaccggagggtgagcccggcagaggcagagacacgcagg

SEQ ID NO: 543 - DNA, 221 bp, Homo sapiens
  CDS 87..221
  sig_peptide 87..209: Von Heijne matrix score 4.30000019073486 seq HLFTLGFLCSLCP/HP
  misc_feature 154: n=a, g, c or t Oligonucleotide
tgctatgttcaatcttgtacaggtcttttgtggacatatggtctcactcctcttaggtatataccgagtagtgaaactgccaggtcatgggagtatacacgtgtccaatttttgtgcattactacgagaaccatggaccaaccccwagtttccntgcctttatttcctttcatctatttactttgggctttctttgttccctatgcccccacccccacggg

SEQ ID NO: 544 - DNA, 375 bp, Homo sapiens
  CDS 307..375
  sig_peptide 307..354: Von Heijne matrix score 4.30000019073486 seq SVSCCSSLWVSLS/KD
  misc_feature 302: n=a, g, c or t Oligonucleotide
tcaatggaagaaggagwaaaaagagaagaggaaaatgggaccaatactgctgatcatgttcgaaattccagttgggcaaaaaacggctcctaccaaggtgctcttcataacgcctctgaagaagccacagaacaaaacatacgagctggtacccaggcagttttgcaggtggatcactttatggctatttttaaaaataaaataatcattaaatatttctgttcagtatttcagtatacagtatacttttcacaatataaaaatagaagcttaatactgggcattcatactttttaaagagnatgaatgaagaaatcggtttcctgctgtagttctctatgggtaagtcttagtaaagacgagaatgctgaaatg

SEQ ID NO: 545 - DNA, 376 bp, Homo sapiens
  CDS 260..376
  sig_peptide 260..349: Von Heijne matrix score 4.30000019073486 seq TVLLSGSPRAVVS/AV
tagtggacagcccaagctgcttctcttagaatggctgtggcttcacaagtgatgagaagagcatgcgcttgatttcagatccccattacaagctcataatgaatgagtcacaggagaaaggtgrgacttggggccctttcgtgcctgatgggaagctcctgcmaccccggggagcccctccagactgtccttgcccacctggctgcactggcctctttatgccaacccagtgaggacaggttctgagggacctggacagatgctgctgcccctagccatggctggacgatgttatacagccaagcacagcacwgtgctgctctcaggaagcccaagggctgtggtcagtgcagtggtgatggtgggcacagggtgc

SEQ ID NO: 546 - DNA, 109 bp, Homo sapiens
  CDS 30..107
  sig_peptide 30..86: Von Heijne matrix score 4.30000019073486 seq LRAFLLSVPLGKG/SA
cccacagccttccctggtgtgcctgcagtatgccatcctgctgctaccttagggcttttctgctctctgtccctctggggaaaggctcagcccttaaggatcccgtgct

SEQ ID NO: 547 - DNA, 306 bp, Homo sapiens
  CDS 3..305
  sig_peptide 3..74: Von Heijne matrix score 4.19999980926514 seq LLLSSLWIVCCLH/LD
atatggttgctgacaaggaggtgcagacaaggaccctcttgctttcctcactatggatagtctgttgcctccatctagattctcttatttcarrraaatatcctctccatgcaattaggagatatttatcgacgctgagaaaccaaagagccgaagaacaggttgcacgttttcaaaaaatacctaatggtgaaaatgagacaatgattcctgtattgacatcaaaaaaagcaagtgaattaccagtcagtgaagttgcaagcattctccaagctgatcttcagaatggtctaaaacaatgtgaag

SEQ ID NO: 548 - DNA, 148 bp, Homo sapiens
  CDS 89..148
  sig_peptide 89..130: Von Heijne matrix score 4.19999980926514 seq HICLFFSFSXXFX/LF
aggatagctgaaaggagttcatctaactggagtcccactagaagtaagaaacccctattgtttattttttaataatgtaatttttattatgcatatttgtctttttttttctttttctttwwctttttktcttttctttttttttttt

SEQ ID NO: 549 - DNA, 374 bp, Homo sapiens
  CDS 240..374
  sig_peptide 240..296: Von Heijne matrix score 4.19999980926514 seq ILARLCRMQTCWC/LS
tacattcggcccggccatggcagcggcgcccctgaaagtgtgcatcgtgggctcggggaactggggttcagctgttgcaaaarkrattggtaataatgtcaagaaacttcagaaatttgcctccacagtcaagatgtgggtcttttraaraaamcrgkkrakkggcagraaactgacagacatcataaataatgaccatgaaaatgtaaaatatcttcctggacacaagctgccagaaaatgtggttgccatgtcaaatcttagcgaggctgtgcaggatgcagacctgctggtgtttgtcattccccaccagttcattcacagaatctgtgatgagatcactgggagagtgcccaagaaagcgctgggggggg

SEQ ID NO: 550 - DNA, 476 bp, Homo sapiens
  CDS 147..476
  sig_peptide 147..398: Von Heijne matrix score 4.19999980926514 seq VTILVSLALAFLA/CI
agacacacgcgaggcgctgtcctttcagcaccacaagctcgggctgaggagggaggactcctggccgtcctcctcckcttcaaattggcttgaatctgctctgaccccccacgagtgcagcacagtctgggaagaaaggcgtaaggatggwgaagctgarcagtaaccccagcgagaagggaaccaagccgccttcagttgaggatggcttccagaccgtccctctcatcactcccttggaggttaatcacttacagctgcctgctccagaaaaggtgattgtgaagacaagaacggaatatcagccggaacagaagaacaaagggaagttccgggtgccaaaaatcgctgaatttacggtcaccatccttgtcagcctggccctagctttccttgcgtgcatcgtgttcctggtggtttacaaagccttcacctatgatcacagctgcccagaggattcgtctatragcaccggg

SEQ ID NO: 551 - DNA, 231 bp, Homo sapiens
  CDS 77..229
  sig_peptide 77..139: Von Heijne matrix score 4.19999980926514 seq EVLSLLFXCIYWG/QY
catcctcatcttcttcctctcttgttactttggatatttgctgaaaggtcgtcagttgctccacacaacttataaaatgttcatsgccgcagcaggagtagaggtcctgagcctcctattttkctgcatctactggggtcaatatgccaccgatggcattggcaacgagagtgtgaagatcttggccaagctgctcttctcctccagcttcctcatcttcctgctgatggg

SEQ ID NO: 552 - DNA, 229 bp, Homo sapiens
  CDS 125..229
  sig_peptide 125..202: Von Heijne matrix score 4.19999980926514 seq FLSFLSFFFFSFF/LF
agtttcactccgaaagtscttcttacagagcaactccaaggatgggctgaaaagcacatagagaaaatggaacagtgcgaagttggaaggtccgtgcgggtggcagcgccagtgtggggatgagatgctcacaggacggtttttaggcggctcacaagggttttttctttcttttctttctttcttttttttttcctttttccttttccttyctttttttttttttttt

SEQ ID NO: 553 - DNA, 232 bp, Homo sapiens
  CDS 110..232
  sig_peptide 110..193: Von Heijne matrix score 4.19999980926514 seq FVFMSKLLLFSFS/FL
acgatcagatctgakragaattgagcccccaaaagcagttatcagactatttgaaataaagatttatattcacctttaataacaatgtaccattaataacacatattacatgtttatttkrtawrakatgaaacagwcrtttcatattatagactttgttttcatgagtaaacttttattattttcattttcatttttaaraaaagcrcgcatgawtacagcagcacctggg

SEQ ID NO: 554 - DNA, 141 bp, Homo sapiens
  CDS 31..141
  sig_peptide 31..84: Von Heijne matrix score 4.19999980926514 seq HILTAVLPLVSHQ/QN
ttacattcctcacttctagtggtttgattaatggtcacaccagtacacatcctgacagccgtgcttccacttgtgtctcaccagcaaaaccatctgggtggaaggtttgcatctctgggatcctcaggcattaggcacggg

SEQ ID NO: 555 - DNA, 376 bp, Homo sapiens
  CDS 319..375
  sig_peptide 319..363: Von Heijne matrix score 4.19999980926514 seq ILHLATLLNLFIS/SN
  misc_feature 144..145,202,276..277: n=a, g, c or t Oligonucleotide
ttctatttctgtgaagaatgtcacagaatgcagtctacatattgcatagaatctgtagattgcattgggtagcatggacattttaacaatattgattcttccaattcatgaacatgaaatatctttccattttttgaggtctanncaatctcttttatcagtgtktcctaattctgattatagagatctttcacatctttgnttcaagttgattcctacgtatttcactttatttgtggctgttgtaaatgggattactttttgcatttctttchnnsaattgttcagtcagcatacaggaatgatactgatttttgtatgttgattttacatcttgcaactttactaaatttgtttatcagttctaacagttttg

SEQ ID NO: 556 - DNA, 279 bp, Homo sapiens
  CDS 199..279
  sig_peptide 199..243: Von Heijne matrix score 4.19999980926514 seq LASFGPFRSSCFA/AR
cccttgttactgctacccatcctacctgcaccctgctttttccctcttgscacgctttttttcctctccctcttacccccaccctgtacaaaatgcataaaggatggaaaaactactgcagccagaagtctttgaatgaggcatcaatggatgaatatttaggcagcttagggctgtttcgaaagctgactgccaaggatgcctcttgcctctttcgggccatttcggagcagttgttttgcagccaggtccatcatttggaaatcaggaaggcaaggg

SEQ ID NO: 557 - DNA, 340 bp, Homo sapiens
  CDS 233..340
  sig_peptide 233..325: Von Heijne matrix score 4.19999980926514 seq FLLSFLSFRSPLC/HH
caaagaaattagtggctaaacgtagagaaattaagatgaaggaactggcacatggagccactgtgtactataaagtatttttattggtatttagtcttgctgttattgttgctaatgattgtattgaataattaccagctgttgttagttatttgaaattaggtgcctaaagcaacctctcatcttgcagaaagtcatctttcttgaaactttttaaaaacttgcttgaaacatggagacttggaatgggacgtctatcatagtagcacatctgaratccttctcattcctgctgtcatttctgtcctttcgcagtccactttgtcaccaccccctcggg

SEQ ID NO: 558 - DNA, 365 bp, Homo sapiens
  CDS 288..365
  sig_peptide 288..329: Von Heijne matrix score 4.19999980926514 seq QFLSLIFASCSST/TP
acatttgcaaccttggccatctgtccagaacctgctcccacctcaggcccaggccaaccgtgcactgctgcaatgggctctgagctggagacggcgatggagaccctcatcaacgtgttccacgcccactcgggcaaagagggggacaagtacaagctgagcaagaaggagctgaaagagctgctgcagacggagctctctggcttcctggatgtgaaagagcttatgctgtaggcaacagaagccctcaagacttttgaggaggcctagaagagtcccataattcaatgcagttcctctcgctcatctttgcctcctgctcctcaaccacccccttacctctgamtcagtgctgtacccttccc

SEQ ID NO: 559 - DNA, 354 bp, Homo sapiens
  CDS 103..354
  sig_peptide 103..261: Von Heijne matrix score 4.19999980926514 seq VLALVCHSASISV/FP
aatattataatgaggctctgcaggggcttgaacttaggtccctgtaagggagctactgttccctggtatgacccactctagctgagctgtgcagagactgagatggtcacctcaaagagcaggggaccccktgtccagactctggggcatgctggcaacctgaggagtctgcgggagtggcctgatctgtgctgcttgaggctttttgtcccagatcacactgtacttgctctggtgtgccacagcgcatccatctctgtcttcccttctcaggtcacctgcagactcccaaggacagggtcacatcccatctgcgtcatctctcaaggtgcctttcacgatcctcacccaaat

SEQ ID NO: 560 - DNA, 328 bp, Homo sapiens
  CDS 168..326
  sig_peptide 168..248: Von Heijne matrix score 4.19999980926514 seq RLVVLFASPXVRP/AS
  misc_feature 230: n=a, g, c or t Oligonucleotide
attaagggacaataatggccgctttcaaggtgtggattttggctccttgagcctgtctgagcgaggggtggcagcgccggcgccccagaatccgggacagaaagggtcbcaagagtcgcgcttggtgmgagaaatcccagatcctgtgatgggggacaccagtgaggatgcctcgatccatcgatksgaaggcactgatctggactgtcaggttggtggtcttatttgcnagtccaawagtgcggccagcgagcagcatgtcttcaaggctcctgctccccgsccttcattactcggactggacttgctggcttcctgaacggagaga

SEQ ID NO: 561 - DNA, 341 bp, Homo sapiens
  CDS 69..341
  sig_peptide 69..230: Von Heijne matrix score 4.19999980926514 seq TVVFLTLLSVVIL/IF
  misc_feature 270..272,321..322: n=a, g, c or t Oligonucleotide
ccttcaccagcagcccgtccgactggaaagatctgcctcttctccaagaaactcaaccactagtgacaatgaccagcctcctgactactccttctccaagagaagaactgatgaccaccccaattttacagcccactgaggccctgtccccagaagatggagccagcacagcactcattgcagttgttatcaccgttgtcttcctcaccctgctctcggtcgtgatcttgatcttcttttacctgtacaagaacaaaggcagctacgtmnnntatgaacctacagaaggtgagcccagtgccatcgtccagatggagadwnncttggccaagggcagcgag

SEQ ID NO: 562 - DNA, 484 bp, Homo sapiens
  CDS 334..483
  sig_peptide 334..387: Von Heijne matrix score 4.19999980926514 seq LIYLVSSFLALNQ/AS
gttagttgggcagggctgaagtgtatgtggtgaggaaaagaggctcctactgtagacagccttgttctacagatcctcccagaaatctctgggccaggtggaacccagggtcagagagggatgggagagaggtttaattttccatgataaataaaaatctataaaataataaacaagagaaaagagattggaaacagccaggttggagcagtgagtgagtaaggaaacctggctgccctctccagattccccaggctctcagagaagatcagcagaaagtctgcaagassctaagaaccatcagccctcagctgcacctcctcccctccaaggatgacaaaggcgsgvctcatctatttggtcagcagctttcttgccctaaatcaggccagcctcatcagtcgctgtgacttggcccaggtgctgcagctggaggacttggatgggtttgagggttactccctgagtgactggctgtgctggc

SEQ ID NO: 563 - DNA, 229 bp, Homo sapiens
  CDS 122..229
  sig_peptide 122..190: Von Heijne matrix score 4.19999980926514 seq QLILLGIFRGIRH/QI
gaaaggcctcgaaggcagcgtcctactcgaccaccaaggcaagacaagccacctckatttagacggctaagagagagggaggctgcttcaaaatcaaatgaggtggtagcagtgcccacaaatggcacagttaataatgtggctcaagaaccagttaatactcttggggatatttcggggaataagacaccagatttatctaatcagaactcttcagatcaggcaatgg

SEQ ID NO: 564 - DNA, 352 bp, Homo sapiens
  CDS 80..352
  sig_peptide 80..169: Von Heijne matrix score 4.19999980926514 seq LAXTLSLTCSVSG/VS
actttctgagagtcctggacctcctgtgcaagaacatgaaacatctgtggttcttccttctcctggtggcaggtcccagatgggtcctgtcccaggtgcagctgcaggagtmrggcccaygamtggcgaacttgcggrgaccctgtccctcacctgcagtgtctctggtgtctccatcactagttattactggagctggatccgccargccccagggaaggggccggagtggatcgggcdkatcgatcatagcggggataccgactacaatccctccctccagagtcgagtcaccctctcagtggacacgtcgaagaaccagttctcactgaggttgctttctgtgagcgca

SEQ ID NO: 565 - DNA, 201 bp, Homo sapiens
  CDS 85..201
  sig_peptide 85..192: Von Heijne matrix score 4.19999980926514 seq LPLFLCPLGMVET/SF
agttctgcgctgtgagccggggcacaaagagccctctgcactagcgccgcagaccgcggaccagttggaggcatctgtccacccatgtggttccagacacgttcatgtggccaccatgaccccgtcggcatcacaggggtaaccaaggtgatcctccctctcttcctgtgtccactggggatggtagagaccagcttcggg

SEQ ID NO: 566 - DNA, 422 bp, Homo sapiens
  CDS 87..422
  sig_peptide 87..413: Von Heijne matrix score 4.19999980926514 seq LVFLLMYLFPRQL/LI
ctctcccgcttctctcgctgtgaagatggcgctctccagggtcttcaaagcttcacctttctccaaaggcagatgtgaagaacttgatgtcttatgtggtaaccaagacaaaagcgattaatgggaaataccatcgtttcttgggtcgtcatttcccccgcttctatgtcctgtacacaatcttcatgaaaggattgcagatgttatgggctgatgccaaaaaggctagaagaataaagacaaatatgtggaagcacaatataaagtttcatcaacttccataccgggagatggagcatttgagacagttccgccaagacgtcaccaagtgtcttttcctaggtattatttccattccaccttttgccaactacctggtcttcttgctaatgtacctgtttcccaggcaactactgatcagg

SEQ ID NO: 567 - DNA, 218 bp, Homo sapiens
  CDS 48..218
  sig_peptide 48..104: Von Heijne matrix score 4.19999980926514 seq LSLPSFLCTCCQF/FP
tttcctttctgttttgggagggaagtggagggagttcttttttctttatgtataattattacttcctttcattgccgagttttctttgtacctgttgtcaattcttcccacatgatccaattagctctcagtacagttctccacaagggaaaccatgtcaagtaacctacaagttcttgtttattttgcttggacacgtctatcccagagatggcggg

SEQ ID NO: 568 - DNA, 246 bp, Homo sapiens
  CDS 2..244
  sig_peptide 2..238: Von Heijne matrix score 4.19999980926514 seq LLLVSLLEHLSHV/HE
gatgcaggggggcaactccggggtccgcaagcgcgaagaggagggcgacggggctggggctgtggctgcgccgccggccatcgactttcccgccgagggcccggaccccgaatatgacgaatctgatgttccagcakaaatccaggtgttaaaagaacccctacaacagccaaccttcccttttgcagttgcaaaccaactcttgctggtttctttgctggagcacttgagccacgtgcatgaacc

SEQ ID NO: 569 - DNA, 142 bp, Homo sapiens
  CDS 78..140
  sig_peptide 78..128: Von Heijne matrix score 4.19999980926514 seq CFALCIILICVMS/CR
cacattagttttgaaactagctctaatttctcctaccaggaggaatttcttccttcttggcaatactgtggtatttaatggtattttactgttttgcactttgtattatacttatttgtgttatgtcttgtcgccacctggg

SEQ ID NO: 570 - DNA, 207 bp, Homo sapiens
  CDS 12..206
  sig_peptide 12..140: Von Heijne matrix score 4.09999990463257 seq VLITQLCLGKGQS/EP
tcaatccttgaatgctctgggagactgatttgagtaccaataaaactccagtctcctgcacagctggctctgcgtgtgctctttctctattgcaattccctgtcttgataactcagctctgtctaggcaaagggcaaagtgaacccattgggccattacaagattttgtgtctttggaaagcacttcacatttttattctttttttt

SEQ ID NO: 571 - DNA, 373 bp, Homo sapiens
  CDS 276..371
  sig_peptide 276..335: Von Heijne matrix score 4.09999990463257 seq LWCCSPSSRTSSS/LS
  misc_feature 251: n=a, g, c or t Oligonucleotide
attctgcagccaactttgttcaccatctccgcaatgccttggacgtcctgcatagagaggtgcccagagtcctggtcaacctcgtggacttcctgaaccccactatsrtgcggcaggtgttcctgggrracccagacaagtgcccagtgcagcaggccagcgttttgtgtaactgcgttctgaccctgcgggagaactcccaagagctagccaggctggrggccttcagccgagcctaccggagcagcatnbcgagctggtggggtcaggccgctatgacacgcaggaggacttctctgtggtgctgcagcccttcttccagaacatccagctccctgtcctggcggatgggctcccagatacgtccttcttt

SEQ ID NO: 572 - DNA, 195 bp, Homo sapiens
  CDS 134..193
  sig_peptide 134..187: Von Heijne matrix score 4.09999990463257 seq WCFHAVFFTVCVC/VR
gtgacaaagtaccacagactgggtggttgaaacacagaaatttattttctcacaatttcggaggctctagaagtctgagatcaaggtgttggcaggtttggtttattctaaggcctttctctatggcttgtagatggccttctatctctggtgttttcatgcggtctttttcactgtgtgtgtgtgtgtgcgggg

SEQ ID NO: 573 - DNA, 352 bp, Homo sapiens
  CDS 173..352
  sig_peptide 173..271: Von Heijne matrix score 4.09999990463257 seq PLIHLTLSGHSTC/FR
tcattcttgggtgtttctcgcagagggggatttggcagggtcataggacaatagtggagggaaggtcagcagataaacaagtgaacaaaggtttctggttttcctaggcagargacccttgcggccttccgcagtgtttgtgtccctgggtacttgagattagggagtggtgatgactcttaacgagcatgctgccttcaagcatctgtttaacaaagcacatcttgcaccacccttaatccatttaacbctgagtggacacagcacatgtttcagagagcacagggttgggggcaaggtcatagatgaacagcatcccaaggcagaagaatctttcttagtacaggagggg

SEQ ID NO: 574 - DNA, 121 bp, Homo sapiens
  CDS 35..121
  sig_peptide 35..112: Von Heijne matrix score 4.09999990463257 seq SLASFLLLTFLPS/LP
accttccttctctccttctttccttccctccttcatgtctttctcttcctctctccctccatctctccctccttccctcgcttccttcctccttttgaccttccttccttccctccctcgg

SEQ ID NO: 575 - DNA, 391 bp, Homo sapiens
  CDS 77..391
  sig_peptide 77..214: Von Heijne matrix score 4.09999990463257 seq GCAPLRWVPQIRG/CP
  misc_feature 31..32,314: n=a, g, c or t Oligonucleotide
aaaaactgtssagacttttgcccgtccattnncrctatctctccccactctgggtgtcctacccaaggcgctgtctatgcgtgcccagggcctgtcctgcggatacccagctcgccccttgcagccctttttagagcatctcgcgggctctggcatcaccaagcgcacagccccgggctgcgctcccctaaggtgggtccctcagatccggggctgtccattaaccaggctggcccaaagaggcgcagacactcgaacccgggaaaacttattttattctcggttcccggggttgcagctgccagcggctgaknacagtgcgtccgctttgtctctctgcactccccgcagcccccctctcccgcttcctctcccgattaactcccccggg

SEQ ID NO: 576 - DNA, 288 bp, Homo sapiens
  CDS 133..288
  sig_peptide 133..243: Von Heijne matrix score 4.09999990463257 seq SISFLPFQASIFG/KT
aaaggcacagcgcgggcgcaggcgcccagaggcgacaggagacctcaggcccagactccactccccagctgtgaaaggactgctggccagacccccaagctagcccgccaggcctccatagagctgcccagcatggctgcatccagtaccagtcatcttaaaaataaaacaaaaaccttccttgcccccatgaccaactgccactcaatttcctttcttcctttccaagcaagtatttttggaaagactcgtctgcagtcactgaggccttcccacccttacccccac

SEQ ID NO: 577 - DNA, 264 bp, Homo sapiens
  CDS 134..262
  sig_peptide 134..250: Von Heijne matrix score 4.09999990463257 seq FXSCXCVSTLAYT/KG
attacacagtagagggaggaagctaaaggaagtctatggacaggtgagggagggkgagactggggaattttctgattgttcagaggaatcttgaagatgatggaaatatcagatgtgctaaagtttcctagtaatgcccaaggatgctgacctggctttcagtgcttcattgtttgaaagagcagagtccctttatactctgatttcaaaatttktttcttgtdtktgtgtgtctaccttggcatatactaaaggaaggggggg

SEQ ID NO: 578 - DNA, 205 bp, Homo sapiens
  CDS 115..204
  sig_peptide 115..198: Von Heijne matrix score 4.09999990463257 seq MPFLFLTLFHCLG/RR
  misc_feature 94: n=a, g, c or t Oligonucleotide
tgtagaaatacagwtgatgtttaatagtgatcttgtatcctatacccttgcaaactccacttcttagttccagttactttattgtasytttttnhttgtyytttactgtgtgtgatgtttgtgaatagaacctgttttaattcttcctttccaatctggatgccttttctttttcttacattattccactgcttaggacgtcggg

SEQ ID NO: 579 - DNA, 214 bp, Homo sapiens
  CDS 25..213
  sig_peptide 25..135: Von Heijne matrix score 4.09999990463257 seq HFLXAVSASSSXA/CL
gcctcctctwgcgctgtcctgttaatggygggcagtagccgctgmvkgggattgcagataaccgcttcccgcacggggaaagtctaccctgcctgccactttctgskcgccgtcagcgccagtagctcgcmagcatgtctgtggtaccgcccaatmgctcgcagaccggctggccccggggggtcactcagttcggcacaagtacatccagcag

SEQ ID NO: 580 - DNA, 328 bp, Homo sapiens
  CDS 28..327
  sig_peptide 28..105: Von Heijne matrix score 4.09999990463257 seq VTFWLLCRICTFG/FH
tgtttgtgatcagtatccaaaggcaaaatgattttgtttgaccatttacattgttcagcatcaggagtgactttctggttgctttgcaggatctgtacgtttggttttcatggtttttctaaatacacagtttcacgtggaacacagcagggggcaggaavgtgvdgtggattacaccagaactgggaacagtggagggggcttgttgggaagtctagttctgccgcagttgttttctgccttacstttgacttggttaccagctttcaattagcaagtgcaattgaaagtacacatttccatgctgggcgcgatggctcacacctgt

SEQ ID NO: 581 - DNA, 356 bp, Homo sapiens
  CDS 264..356
  sig_peptide 264..350: Von Heijne matrix score 4.09999990463257 seq LLLFPASLRLLCV/HP
  misc_feature 146: n=a, g, c or t Oligonucleotide
gtckcattttgcctttgwaatggaagtcacttccaagtgtctgttctctaggttttcctttttttctcttttagaaattggacacttcaataaaatttgtaattacgtccatctgwgtgahtattwgmattyratgkscatatctnstgccagattgtaaactccgcgagtgcacatatcagatccattatggttctcatcatatccctagctcctagcgcagtgcggggcacgtataagtgctcgaaagctcccacgtggtgatggagctaagcttgcccccttccatgtgtgactacccaamtttctgtctcctcctcttcccggcctctctcagactcctctgtgtgcatccc

SEQ ID NO: 582 - DNA, 239 bp, Homo sapiens
  CDS 159..239
  sig_peptide 159..218: Von Heijne matrix score 4.09999990463257 seq TVGCAGLAGSCRG/IS
agttcctgggctcccgcggagsatgagacgttgtgaattagatgtgagaagagggacgcttggtctgcgaccaccaagaccccacaggatcgatgcacccacccctgctgatgaccatgaccatctaaargggaaacatcatttgaggggccctactcatggatcagaagcccctcttcactgtggggtgtgctgggttggcgggcagttgccgtggaatcagtttcctcaggacccgc

SEQ ID NO: 583 - DNA, 144 bp, Homo sapiens
  CDS 8..142
  sig_peptide 8..76: Von Heijne matrix score 4.09999990463257 seq FILLLLIQDLTMS/PT
ttttaaaatgtcagttaatgmtatttttattttctattttatcttattattattgatacaagatctcactatgtcacccactgctggaatgcagtggcataatcatggcccaccacaagccttgccttgcccactgagaabccc

SEQ ID NO: 584 - DNA, 282 bp, Homo sapiens
  CDS 47..280
  sig_peptide 47..181: Von Heijne matrix score 4.09999990463257 seq ICLGSPLAECLLG/XX
  misc_feature 183,210: n=a, g, c or t Oligonucleotide
ccttgtttaagccgtgatcgtgacctcaccatgtgtagacagtgagatgtcatttctcaatgtggacatcacagattgcctgtataaccccagtgtgtgtcccgtggctcagagcagtctgacctgtgacttcatagatggtatctgcttggggtcgcctttggctgagtgtctgcttggtgnagwawkwkscattttkggratcaatrnscymtgctttccgtgtggtgtgaagtgcgcaggtgtggtcttggggctgagcaccctgtggtatgttgtagc

SEQ ID NO: 585 - DNA, 388 bp, Homo sapiens
  CDS 242..388
  sig_peptide 242..352: Von Heijne matrix score 4.09999990463257 seq FTFLSPSFHSVHL/SE
tgcatttttaaaaatagctagaagaaaagaactttaatattcccaaaacaaataaaatataaatgtttgaggtgagggatatcccaattaccctgatttggttattattcattgtatacagttttcaaaatatcacatgtacccccaaaatatgtaaaactgttatatacaaataaataacaaaactaaaaataacagctgtgcaaacatttttaaaaggcttgctttaaatgggtttcacatgaaagtaggaaaggactctctggagtctttaccatctttatgtgagaaacacattggtcccagtggtctctttacctttcttagtccatcctttcactctgtacatctttctgaactcaatgaattatacactattgctgccggg

SEQ ID NO: 586 - DNA, 436 bp, Homo sapiens
  CDS 346..435
  sig_peptide 346..396: Von Heijne matrix score 4.09999990463257 seq VLISASLLRASQL/KI
  misc_feature 170: n=a, g, c or t Oligonucleotide
tgtgctgtgtggttaggagaaggagggatgggagagagaaggggaaggaatgaggcatggagagagatcacaaccatcgtctcaatgaagcagcagcacacacagggatgtgtggtcgwcccaagttcaggggagagagtttaaaggcgggatgatcatatgtgaagdhntggcagcaccaatatggcactgtcaaagtaaaagagaaatagatctgaactggattttaatgagaataatagcaaatattaacatttcttagatagtttgatatttattctggaagtatcgctaccaacatcaacatctgggaaagcdagtgggcatcaaaatcctacctggctaatggaaagcaaagttttaatcagtgcatcactcctacgggcctctcaattaaaaataaaatgraacaaaatgacaaacttcttaattttgt

SEQ ID NO: 587 - DNA, 378 bp, Homo sapiens
  CDS 24..377
  sig_peptide 24..95: Von Heijne matrix score 4.09999990463257 seq RLPMLSLFRGSHX/XF
tcctgtcctgggcgtacgtcaagatggcggcgtctgtattaaacaccgtgctgaggcggcttcctatgctatctctcttccgaggttctcayvvgrbgttcaggttcccctccagactctttgcaccaaagctccctctgaggaagattctttgtcctcagttcccatttctccttataaggatgagccctggaaatatctggaatcagaagaataccaggagcgatatggttctcgccccgtctgggctgactaccgccgcaaccacaagggtggtgtacccccacagcggactcggaagacatgtattcgtcggaataaagttgttgggaatccctgccccatctgtcgagatcacaagttgcatgttgactttag

SEQ ID NO: 588 - DNA, 413 bp, Homo sapiens
  CDS 185..412
  sig_peptide 185..238: Von Heijne matrix score 4.09999990463257 seq TLLTCLXLXGGEG/WK
  misc_feature 218,224: n=a, g, c or t Oligonucleotide
aggaggcgcagttactgatatagccaaggtgggacactactggagggagctagaagggatcagccagccatgcctccagttcaggtacttggcattgctaagctcagaacaggacttgccagtgtctagatgaaaaagaggagagatctcaagagggataaccaattggctggcaaagtaacaaatgaaaagtaacctgactctattgacctgcttanccctgnatgggggggaaggatggaaaggagcagctgtttgctttgaaacggtggaacagttttgcagccttagaaaatggcatgtaacatacctarccaaagacagcggactctgtcaacaacaggagaagctctatacgaaattcttggtctgcataaagggagcatcaaatgaagaaattaagaaaacctaca

SEQ ID NO: 589 - DNA, 210 bp, Homo sapiens
  CDS 138..209
  sig_peptide 138..179: Von Heijne matrix score 4.09999990463257 seq LASPCVLVQGSGX/SL
  misc_feature 78,80,118: n=a, g, c or t Oligonucleotide
gaagataataataatgattattataataatgatgatgattccaaggaaaaaacctacagcgaatgttccatttctacnsngcacgcagacactctccctaacactgataacctgagcncccagcactggacggaagaatgctggcgtctccgtgtgtactggttcagggttctggsbccagccttgtcaggaccccctggtgtccagagc

SEQ ID NO: 590 - DNA, 178 bp, Homo sapiens
  CDS 40..177
  sig_peptide 40..96: Von Heijne matrix score 4.09999990463257 seq ILLLLITIIYSYL/ES
acaaggactgaaccagaaggaagaggacagagcaaagccatgaacatcatcctagaaatccttctgcttctgatcaccatcatctactcctacttggagtcgttggtgaagtttttcattcctcagaggagaaaatctgtggctggggagattgttctcattactggagctgggcatg

SEQ ID NO: 591 - DNA, 308 bp, Homo sapiens
  CDS 149..307
  sig_peptide 149..265: Von Heijne matrix score 4.09999990463257 seq PSLIAGLFVGCLA/GY
  misc_feature 272: n=a, g, c or t Oligonucleotide
gcgagacggctgggcgccgagtgggacagcgctggtgcggagactgcttccggactccaggtaccgcgcttggcggcagctggccccagacttctgtcttttcaagmkgcaagtraargctcggggctgcrraattgcaaccttgccaatggacctgatcggttttggttatgcagccctcgtgacatttggaagcatttttggatataagcdgagaggtggtgttccgtctttgattgctggtctttttgtdggatgtttggccggctatnsagcttaccgtgtctccaatgacaaacgagatgtaa

SEQ ID NO: 592 - DNA, 219 bp, Homo sapiens
  CDS 16..219
  sig_peptide 16..72: Von Heijne matrix score 4.09999990463257 seq XTFLAAXRRLVTG/QT
acagttcatccggaaatggagggggtcgctttvbtcaccttcctcgctgcgsggcggcggttggtaaccggtcagaccagcccgagagggacctggtgcctgtacccaggcttctgtcgctctgtcgcctgcgctatgccctgctgtagtcacaggagctgtagagaggaccccggtacatctgaaagccgggaaatggtgcgtgtgcgggaccacggg

SEQ ID NO: 593 - DNA, 215 bp, Homo sapiens
  CDS 105..215
  sig_peptide 105..167: Von Heijne matrix score 4 seq IGLIGLTVPCGWG/SL
aggaacattttttattttatttttatagagatagggtctctttctgtagcccaagctggagtactgtcttagtctgtttttatgctgctgataacgacatacccatgactgggcaatttacaaaagaaataggtttaattggacttacagttccatgtggctggggaagcctcataaccatggcagaaggcagggaggagcaagtcacgtctggg

SEQ ID NO: 594 - DNA, 161 bp, Homo sapiens
  CDS 89..160
  sig_peptide 89..130: Von Heijne matrix score 4 seq HLGFILSFHGLIA/NF
ctccatagttttaccttctccaggatgttgtatagatggaattgtacagtatgtagccttttcacattggcttctttcactaaataacatgcatttaggattcattctttctttccatggtttgatagctaatttctttttttgtctgaatgcaccagcgg

SEQ ID NO: 595 - DNA, 396 bp, Homo sapiens
  CDS 317..394
  sig_peptide 317..376: Von Heijne matrix score 4 seq GCVAAGVVIGAGA/AT
  misc_feature 149: n=a, g, c or t Oligonucleotide
actcttcctatagcccagagggcgagagggcctgtggcctgggggaaggaggacgaggttctgcctggmtcccagcaggacgctgtgccatttgggaacaaaggaatagtctgcctggaatccctgcagatcttggggccggaggcagntccaacccttggagcaggaagaaacgcaaagttgtcaagaaccaagtcgagctgcctcagagccggcccgcagtagctgcagactccgcccgcgacgtgtgcgcgcttctctgggccagagcgagcctgttttgtgctcgggttaagagatttgtccbagctataccatgggccgcactcgggaagctggctgcgtggccgctggtgtggttatcggggctggtgctgctactgtgtatacagactg

SEQ ID NO: 596 - DNA, 407 bp, Homo sapiens
  CDS 228..407
  sig_peptide 228..341: Von Heijne matrix score 4 seq FKPXSCLSLLSNX/DY
tgagttttatgmttgatttatatcttttggttacaagtcctttgtcagatatatgatttgcaaatattttctcactctgggtaggttgtctttttactttcttgataatgtcctcttttgttgcttgtgttatctccttttttgttttttattctttttaaagttatctcttacaggaaggattccttttttcttaaaaaagtttttcaattctttttttttttgagatggagtctcactctgtcgcccaggctaggatgcggysgcawaatctcagctcactgcaacctctgccgcctgggttcaagccattstcctgcctmagcctcctgagtaaytsagattacaggcatgcaccaccattcctggctaattttkgwatttttcatagagatggagtttcacca

SEQ ID NO: 597 - DNA, 274 bp, Homo sapiens
  CDS 90..272
  sig_peptide 90..254: Von Heijne matrix score 4 seq LHQGLCLPQRVHC/SL
gctgaccgrgcgcacsccgcccccggsgccatcttcccgaccgcgagccgtccaggtctcagtgctrtgccccccccagagcctagaggatgtttcatgggatcccagccacgccgggcataggagcccctgggaacaagccggagctgtatgaggtacgacaacatggcagagctgtttgcggtggtgaagacaatgcaagccctggagaaggcctacatcaaggactgtgtctcccccagcgagtacactgcagcctgctcccggctcctgg

SEQ ID NO: 598 - DNA, 417 bp, Homo sapiens
  CDS 343..417
  sig_peptide 343..408: Von Heijne matrix score 4 seq LFLSVLNFLFLLS/FS
gcatctagaagtacaagttgatgattattgtccatttgatagagacactggaagggtgtcagtgtaaacactggccatgtgaagattgagcctgttgatggtttcttttgtatcataggatgccacgtcaccaactagggaattctgcccaatcagttgagccaaatagtgctgtcctattgtaaaattgtttaatctgtgtgcttgtgtgtgtgcttgtcagaatttgtgaatcatagaattgttttaactggaagaagacccccaagatcatctgcttcaaccccttccttcctctcttttccagagaggttgcactttacttgagctgtgactaggattatgccacattcttttgtaagttgtaacctatttttgtctgtrttgaatttcctttttttgctaagctttagcaca

SEQ ID NO: 599 - DNA, 329 bp, Homo sapiens
  CDS 240..329
  sig_peptide 240..317: Von Heijne matrix score 4 seq HHLLLSTLATIAG/NI
agaagactggaactcagcaagaaagtgatgaaaatgctctgagacatagaaactctagacggcagcatagaaatggaagaaaaatacccagccagatccagctcagagccaagaaaatgtacacaccagatccccagcattcccaattatcacaaaaggtgccttaatttctatctacaagacaaccctacaatcctcacaggccctgagctcagtatagaaagttttctggagtccatatggctgtttttctccaaaagaggaaacacacaatgagacaccacctactcctcagtacactggctactatagcaggcaacatttacaga

SEQ ID NO: 600 - DNA, 311 bp, Homo sapiens
  CDS 169..309
  sig_peptide 169..246: Von Heijne matrix score 4 seq PVAVEALLRAVFG/VV
acagaggcggcaagactagggtggaggaaagctcaagggccatcgctgggtgcttcggtggcgggcagaaacgggactggcagtgcccacacgtgtgcgttctccccgtccgcccgaaggagctacctgtgcaccctgcctccggctctcctgagcagagagatcctgatggctgactcagaagcactcccctcccttgctggggacccagtggctgtggaagccttgctccgggccgtgtttggggttgttgtggatgaggccattcagaaaggaaccagtgtctcccagaaggtctgcsmgtggaagga

SEQ ID NO: 601 - DNA, 420 bp, Homo sapiens
  CDS 159..419
  sig_peptide 159..266: Von Heijne matrix score 4 seq LAELPVSSPLCHA/VL
  misc_feature 365..366: n=a, g, c or t Oligonucleotide
ctaagccttttctaccctcttctcaaagtagagccgaatatgattcagaggagagtctgggaagtgatgatgatgacaatgatgatgatgatgatgttttagcatcagatttccatctccaggaacattctaattcaaattcatatagttggtccttgatgcggttggcgatggtgcaattggtgctcaacaatttgaagactttttatcccttcgcagatcatgatcttgcagagcttccagttagttcacctctttgtcatgcggttctaaaaactcttcaatgttgggaacaagttcttctccgacgacttgaaatccatggtgggccacctcaaaattatatcgcaagtcataccgccgannagagtttgtctgcaggtcctgcaattcttcgccacaaagctttactggaaccta

SEQ ID NO: 602 - DNA, 463 bp, Homo sapiens
  CDS 311..463
  sig_peptide 311..370: Von Heijne matrix score 4 seq LFILXYFXXYTLS/SG
  misc_feature 353..354: n=a, g, c or t Oligonucleotide
tggcaaagacaaagagttgaaacttatatggcagaatcagagctcacaatggtgctgggcatttggggttttgagtcttctctgaagatctttgacatctttagctttattctacaggccacggggaactactggatatttgaaagaaggaatttatctgtctatcttctatttatctatctgtaatctatcatctaatctaggaaatgatagatctaggaagatgatagctagataaatatcagtcatcttcctatcatctgggaaatagatttattttgttttattattttaattaattaatttaaaaatgtttaaattatttttatttttatttattttattwtatttcnngvattacactttaagttctgggatatatgtgcagaatgtgcaggtttgttacataggtatacacatgccatggtggtttgctgcacccatgaacctgtcatctgcacta

SEQ ID NO: 603 - DNA, 269 bp, Homo sapiens
  CDS 182..268
  sig_peptide 182..244: Von Heijne matrix score 4 seq LIPLLSEILYALA/NI
tgtttacaaaagtatcttgaatttgatagagcttatgttgagaaataatttttaatcttttaattccatttttccatgaactttttgaagtccccgtatacatactttttcatggtgagaacacttataatctactgtcagcaattttcaaatataaaatatattattaactgtagtcaccatgatatacagtagatctcttgaacttattcctcttttgtctgaaattttgtatgctttggccaacatctccccaatcccccagacgg

SEQ ID NO: 604 - DNA, 351 bp, Homo sapiens
  CDS 297..350
  sig_peptide 297..344: Von Heijne matrix score 4 seq VIFYFVLFLGIMT/QR
aagaacattatattttcaaatggaataataataccatcagtgaaataaatgttaaaatttttagggcagagattaatgcccaccagaaaggtaactttgatgagggtagcaagcatgctttcactgaaaagtatttttttttcctcttttcaagattctcataattataacccataaaactaagttagacttgtttcttatgtgcatttatgatttaattaacgagagtacactttgtatgacaaaatgcaattttaaggtaaacactatggagaataatttcttttcctagtgaaatggtgcacgttatattttattttgttttatttctagggataatgacacagcggg

SEQ ID NO: 605 - DNA, 195 bp, Homo sapiens
  CDS 37..195
  sig_peptide 37..111: Von Heijne matrix score 4 seq LIYFFQLHSCCHD/KV
agtgaagaatctaagkccagagaggtggtagttaacatgcacaaattctttagacatttctattcagattttctgatttatttctttcagctccattcatgttgtcacgataaagtractgcmcraagggcctatrttcactacagcagcctcttaactccttacctctctcagcacccctgcccccatcccggg

SEQ ID NO: 606 - DNA, 426 bp, Homo sapiens
  CDS 63..425
  sig_peptide 63..140: Von Heijne matrix score 4 seq LLRELRYLSAATG/HP
  misc_feature 174: n=a, g, c or t Oligonucleotide
ggaggaggggttttcagggtcgtaggacgccgttgggcaccacgctcggagaagacaggacaatggcggccttagggtccccgtcgcacacttttcgaggacttctgcgggagttgcgctacctgagcgcggccaccggccaccctatcgcgacaccgcggcctatcggtaccnttgtgaaggctttccgtgcacatcgggtcaccagtgaaaagttgtgcagagcccaacatgagcttcatttccaagctgccacctatctctgcctcctgcgtasatccggaaacatgtggccctacatcaggaatttcatggcaagggtgagcgctcggtggaggagtctgctggcttggtgggtctcaagttgccccatcagcctggagggaagggctgggagccatgaacatggagaatatccttggatgc

SEQ ID NO: 607 - DNA, 161 bp, Homo sapiens
  CDS 71..160
  sig_peptide 71..154: Von Heijne matrix score 4 seq VSLFLLVVLYHYA/AV
agttccggtccaggtctctgacttcgggcttgttcgctggtggcgtcggagccgagccggactggtcaggatgatcacggacgtgcagctcgccatcttcgccaacatgctgggcgtgtcgctcttcttgcttgtcgttctctatcactacgcggccgtgg

SEQ ID NO: 608 - DNA, 357 bp, Homo sapiens
  CDS 283..357
  sig_peptide 283..336: Von Heijne matrix score 4 seq LSFLCSLSQNALN/IS
tgaaccttgcttttatacaaatcacttttttgttatttgaggaacaagataacattttcttggcaggattactatagtccccccaacaagctctaccamagaagataatagaacttattgagcttaaatgaattataggamagttcctgaaaagtccaargtaaatgtgaagagaacccgattctcttaacctcacccaacccagcacttgattctcccttgtttcctggttttcatacacacactgggaaaggamaaggaagaagaaacaaggatgtcgttatggctgaaggagctttgagcttcctttgctctttatcgcaaaatgcattgaatatttccctcatttctcgtaag

SEQ ID NO: 609 - DNA, 201 bp, Homo sapiens
  CDS 133..201
  sig_peptide 133..180: Von Heijne matrix score 4 seq SFLLCFTLVGTQL/RN
ttatatgttctgcttatgggactttgcatgttctacaaactacaagtatctttttctactctgaattgaatttagctctgtttacggttttcttttctgtgagcagaagttcttaatgattactgtagtcaaatgtatccatcttttcttttatgcttcacactcgtagggactcagttaagaaattcttccttagccatg

SEQ ID NO: 610 - DNA, 281 bp, Homo sapiens
  CDS 223..279
  sig_peptide 223..267: Von Heijne matrix score 4 seq SCTVGCATASSWG/CT
accgccttcccacatcggatcgcagggctcccaaaatggcgagtgagactgcggggactcgctgagcagcggagggggagcgtgcagarmmgctgcggccctcacagtccggagcccggccgtgccgtgccgtagggaacatgcacttttccattcccgaaaccgagtcccgcagcggggacagcggcggctccgcctacgtggcctataacattcacgtgaatggagtcctgcactgtcgggtgcgctacagccagctcctggggctgyacgagcagggg

SEQ ID NO: 611 - DNA, 241 bp, Homo sapiens
  CDS 28..240
  sig_peptide 28..156: Von Heijne matrix score 4 seq AAWCSLVLSFCRL/HK
agcttccgggtttcctgggctactacgatggcgatgagtttcgagtggccgtggcagtatcgcttcccacccttctttacgttacaaccgaatgtggacactcggcagaagcagctggccgcctggtgctcgctggtcctgtccttctgccgcctgcacaaacagtccagcatgacggtgatggaagctcaggagagcccgctcttcaacaacgtcaagctacagcgaaagcttcctgtgg

SEQ ID NO: 612 - DNA, 176 bp, Homo sapiens
  CDS 106..174
  sig_peptide 106..147: Von Heijne matrix score 3.90000009536743 seq RLHVHSLSPFSFA/CL
aagagccttggaacatctctctgaagaataaaacaaatcttttctgcatgtataatcgatataaatttgattatattgtactttttatttcgtgtgtgtgtgtacatgagattacatgtacattccctttctcccttttcctttgcttgtctcccttttctgtcccccccgctggg

SEQ ID NO: 613 - DNA, 342 bp, Homo sapiens
  CDS 258..341
  sig_peptide 258..335: Von Heijne matrix score 3.90000009536743 seq RMCILQLLSAVLY/RF
catttctatkaaaatacaaatttaaggctgtagatttaatatgtagtatgttcattrrgttccaaatacattctaatttccactgtgatttctwctttgactcmtgaawtatttagvaggtgwttttgwhttabdwatttctgactgtatggggattttctagttagtttwctactcttaatttgtcttcagagamaatactccacaagatttcagtctttcaattttgttgcaacttgctacaaacttggcctaacatgttgcattttwtatatatgatccawgtgtgcttggaaagaatgtgcattctgcaattgttgagtgctgtgttgtatagatttg

SEQ ID NO: 614 - DNA, 154 bp, Homo sapiens
  CDS 48..152
  sig_peptide 48..137: Von Heijne matrix score 3.90000009536743 seq VGLLDTPLGAVSA/HH
  misc_feature 17: n=a, g, c or t Oligonucleotide
agtcggagcgaaggvcntggcggasagaacggattgcagggtcagccatgtcatctgagcctcccccaccaccacagccccccacccatcaagcttcagtcgggctgctggacacccccctcggagccgtgagcgctcaccatcccctctgccc

SEQ ID NO: 615 - DNA, 272 bp, Homo sapiens
  CDS 185..271
  sig_peptide 185..244: Von Heijne matrix score 3.90000009536743 seq FLTSISFLALVLW/NV
caactataatagcttttaaacttgtttctctttccttttccttcatttcagtccatcttattatctttgacaaaataatttctctgatgcctgactgcctgccccccaacaacaaagcttttattatacttcttaactaatcaactatwmcyttacccatctagccaaagtagactacccatatatgtttcttgaccatgtcaggtttttaacctccatatcttttcttgctctggtcctgtggaatgtctttctcaactctacccgtctgg

SEQ ID NO: 616 - DNA, 114 bp, Homo sapiens
  CDS 36..113
  sig_peptide 36..92: Von Heijne matrix score 3.90000009536743 seq PALLTSSELPALA/SQ
aggtttttagtcttgacctcttgacctgcttatagatgagagaaaagccacaaccagcgctcctgacttcaagtgarctgcctgccttggcctctcaaatacattgccgcgtcc

SEQ ID NO: 617 - DNA, 171 bp, Homo sapiens
  CDS 56..169
  sig_peptide 56..133: Von Heijne matrix score 3.90000009536743 seq VPVLCIWRAWLRA/EV
aaaatgacgatttctcaggaaatcatttcgactcctctttccctgcccaaggaggatgccccacaaccacttggagggagatgctttgctgagagtccctgtcctctgcatctggagagcttggctcagagctgaggtgggagggagggctcctcttccaggtcgcatggg

SEQ ID NO: 618 - DNA, 240 bp, Homo sapiens
  CDS 160..240
  sig_peptide 160..225: Von Heijne matrix score 3.90000009536743 seq CLFWIXLPPHTCT/HT
caaaaaggaaaactgataatatcttaaaaataatatttaactgagtgctggagaaaggggattgaaatgtgagctcctttatattttagctttgccacgtcattgtttttccctcagaaactgtgaaatactttaaatatgagttgttgggaaagttaaatgaaaaatactctttattataatttttgtttattttggattytcctacctccccacacatgcacacacacagacacacat

SEQ ID NO: 619 - DNA, 257 bp, Homo sapiens
  CDS 97..255
  sig_peptide 97..201: Von Heijne matrix score 3.90000009536743 seq CTFLSLSLHPWGG/FF
acttcagaactgggggagagggagaggactggaggcgggagggtggccgctggccagtgcgcactctttcctctgcatccccttccctgcggccccatgtgcctgaaccccgcctgctcgggaccgctttccctccgttcccctcggcttccccctctcttttgcacttttctttccctttctttgcatccctgggggggtttctttttgtgtgcctggatttctbktttcctcccgtgggtgtgtgtgtgkgcggg

SEQ ID NO: 620 - DNA, 351 bp, Homo sapiens
  CDS 47..349
  sig_peptide 47..313: Von Heijne matrix score 3.90000009536743 seq RLLVACCLADIFR/IY
agcggagtakygagtcggcaacccggagggtagaaatatttctgtcatggctcattcaaagactaggaccaatgatggaaaaattacatatccgcctggggtcaaggaaatatcagataaaatatctaaagaggagatggtgagacgattaaagatggttgtgaaaacttttatggatatggaccaggactctgaagaagaaaaggagctttatttaaacctagctttacatcttgcttcagatttttttctcaagcatcctgataaagatgttcgcttactggtagcctgctgccttgctgatattttcaggatttatgctcctgaagctccttacacatcccctaaggg

SEQ ID NO: 621 - DNA, 118 bp, Homo sapiens
  CDS 40..117
  sig_peptide 40..93: Von Heijne matrix score 3.90000009536743 seq IAWTATPSSAAFA/QA
atatcctgcctgmgcctgggmcgggtggaggtgtcctgcatggmgtcttgtgaaatcgcgtggactgcaacacccagcagcgcggcctttgcacaagcttttcccacagcctgcaaca

SEQ ID NO: 622 - DNA, 221 bp, Homo sapiens
  CDS 83..220
  sig_peptide 83..157: Von Heijne matrix score 3.90000009536743 seq LLYILSRSSGRRG/KN
aaagatttgaaggaagatgtaagctttaccaaaattaaaaagtaaagggagtaagtggggggaaaaggtgcagaacagtgtaatgtgtcactacttgtggaaaaaattatactcaacacttttgtatatactcagcagatcttctggaagaagaggtaagaatctgataactgcagttgcctccagggcagggaatttaggtgtctggacagaaaaggggg

SEQ ID NO: 623 - DNA, 432 bp, Homo sapiens
  CDS 344..430
  sig_peptide 344..424: Von Heijne matrix score 3.90000009536743 seq SRMVLLSSALLST/EN
  misc_feature 348..349: n=a, g, c or t Oligonucleotide
gtttattgcattttbcacaactcattaaatttaggcttataagtagctgtatcctggtttggtttcacttgttttaattattttttgatgatttaagacactagccatatggattcaagttttttagtttttattttcctacaccataccatagtagaactattactgttgttatttatattttttaaaaaattcacttgtttttctcgagaatttgtgactgatttttatgttatactgcataattcagtaatttcacacattaacaacatccagggtcatgtgaggatgagttttctagcttctgaaatgttctgaggatgtaattttttaataagaggaaatgtnntctcacagactatttgggtgttttccaagtgacttgtcacgaatggttttgctctctagtgcacttctgagtacagaaaacca

SEQ ID NO: 624 - DNA, 233 bp, Homo sapiens
  CDS 91..231
  sig_peptide 91..153: Von Heijne matrix score 3.90000009536743 seq YLCLHLCAFSTEG/WM
agaggaaagagaaaaacatgtaacatgtaacaaattgttttcctaaatgacaactcagaacaatagaaggcattagaagagaccttccatatgcgcccatcacattcttcagcctacctatgtctgcacctttgtgctttcagtactgaaggttggatgaaccgtctgtcctcttctctaaggctggctcctctacctttgtaccctttttgcctacccagcaattcacccca

SEQ ID NO: 625 - DNA, 380 bp, Homo sapiens
  CDS 10..378
  sig_peptide 10..57: Von Heijne matrix score 3.90000009536743 seq RLVWLGLRAPLGG/RQ
aaggaagaaatgtggtcgcggttggtgtggctgggmcttcgggcccctctgggtgggcgccagggcttcacctccaaggcggatcctcagggcagtggccggatcacggctgcggtgatcgagcacctggagcgtctagcgcttgtggacttcggcagccgcgaggcagtggcgcgactggagaaagctatcgccttcgccgaccggctacgcgccgtggacacagacggggtggagcccatggaatcggtcctggaggacagatgtctatacctgagatccgacaatgtggtagaaggcaactgtgctgatgaattactacaaaactcccatcgcgtcgtggaggagtactttgtggcccccccaggtaatatctcttt

SEQ ID NO: 626 - DNA, 276 bp, Homo sapiens
  CDS 27..275
  sig_peptide 27..269: Von Heijne matrix score 3.90000009536743 seq AIVTCKSLASIHA/LP
atcctggttttgggacagcggcaatcatggcgccacctgtgagatactgcatccccggcgaacgtctgtgtaacttggaggagggcagcccgggcagcggcacctacacccgccacggctacatcttttcgtcgctwrccggctgtctgatgaagagcagcgagaatggcgcgcttccagtggtgtctgtagtgagagaaacagagtcccagttactgccagatgtgggagctattgtaacctgtaagtctctagcatcaattcacgctttgccaa

SEQ ID NO: 627 - DNA, 415 bp, Homo sapiens
  CDS 174..413
  sig_peptide 174..353: Von Heijne matrix score 3.90000009536743 seq RLLVARLHMASLA/RR
  misc_feature 7: n=a, g, c or t Oligonucleotide
accggangtggagcctgggagccttgacgttaggaacgaagtctaacctggatctggagccgggtgagatcaaattgggaatgctttcataatgaacgtcaaccagtcagttccacctgtgccaccatttgggcagccccagcccatctacccagggtatcatcagtccagctatggtgggcaatcagggtccacagcccccgccattccctatggagcctacaatggcccagtaccaggctatcagcaaacacctccccaaggtatgtcaagagccccaccttcctcgggggcacctccagcctcaacagcacaggctccttgtggccaggctgcatatggccagtttggcaaggagatgtacagaatgggccaagctccactgttcagatgcaaggctgccctgggtctcagc

SEQ ID NO: 628 - DNA, 318 bp, Homo sapiens
  CDS 214..318
  sig_peptide 214..297: Von Heijne matrix score 3.90000009536743 seq GVAGVCFFRRSDA/SE
  misc_feature 8: n=a, g, c or t Oligonucleotide
amattgmnkhhataractcttaccatcattttaactggataaaaagtgaagtgtctaaagatgtatatatttsgcacgtttgarttcacaagaggaagaacaawtttctagccasgawaccatgahaggattccaaacagagattaaacttgtcctttgaggataggtaatgagtccagaattggtgggttcttggttttgctgacttcaagaatgaagccacagaccctcgcagtgagtgttacagttcttaaagatggtgtggctggagtttgtttcttcagacgttcagatgcgtctgaagtttcttccttctgg

SEQ ID NO: 629 - DNA, 170 bp, Homo sapiens
  CDS 29..169
  sig_peptide 29..157: Von Heijne matrix score 3.90000009536743 seq KCLFLSFAHFLMG/RT
cattttgactggtgtaagatgatatctcatggtggttttgatttgcctttctctcatgatcagtaatactgagctttttttcatacgcttcttgactgcatgtatgccttcttttgaaaagtgtctgttcttatcttttgcccacttcttgatgggaagaacccaccgtg

SEQ ID NO: 630 - DNA, 196 bp, Homo sapiens
  CDS 87..194
  sig_peptide 87..152: Von Heijne matrix score 3.90000009536743 seq SLLSDILFANIFS/HS
gccatttgtatatatttgavaaatatctattcaaatacattgcctgctttaaaatactgttattggtctttttatcattggattgtatgagttctttatatattttggatattagtctcttatcagatatattatttgcaaatattttctcccattcttgggacgtctttccactttcttttcttttcttttcttt

SEQ ID NO: 631 - DNA, 339 bp, Homo sapiens
  CDS 53..337
  sig_peptide 53..304: Von Heijne matrix score 3.90000009536743 seq SSLLIILLPNTQD/LR
agttccgacgaaaaatggcggggtctcctgagttggtggtccttgaccctccatgggacaaggagctcgcggctggcacagagagccaggccttggtctccgccactccccgagaagactttcgggtgcgctgcacctcgaagcgggctgtgaccgaaatgctacaactgtgcggccgcttcgtgcaaaashcggggacgctctgccggaggagattcgggagcccgctctgcgagatgcgcagtgggtacgggaccagttagccagttctttactcatcatcctcttacccaacacccaggatcttaggattcagaaagatcccacaccaggcccggg

SEQ ID NO: 632 - DNA, 433 bp, Homo sapiens
  CDS 171..431
  sig_peptide 171..314: Von Heijne matrix score 3.79999995231628 seq NSLLLLLCLYIYP/HS
  misc_feature 376..377: n=a, g, c or t Oligonucleotide
actctgaaagcagtcttcacagaaacttttcacagaagtcaaatagttaaagcaaattctagatacatggtagagaccaggagaaaatatgaataactttcttctaaacaaggagctcagtggataaaccatacctctagattccttgcttccattttcccagaaacaagatgaggaagagaaagatcagtgtgtgtcaacaaacttgggccttattatgcaagaactttcttaaaaaatggagaatgaaaagagagtccttaatggaatggctgaattcattgctcctactactttgtttgtatatatatcctcatagtcatcaagtaaatgawtddtcttcactgcttaccatggacctgggacgggtagatrnntktaatgaatccagattttctgttgtatacacacctgtcaccaacacgacccctgg

SEQ ID NO: 633 - DNA, 154 bp, Homo sapiens
  CDS 54..152
  sig_peptide 54..143: Von Heijne matrix score 3.79999995231628 seq XFVFVCXLLKCMS/VP
cagttaagtgtatctgtgtgtgagcaagtttatatgtgtacacatgtttgcccatgtgtacttgtctttgtgtgtgtctgtatatgtayaatatgcaatttttakyttttgtgtttgtktgcgwwttgctaaagtgtatgagtgtgcctttgtg

SEQ ID NO: 634 - DNA, 390 bp, Homo sapiens
  CDS 34..390
  sig_peptide 34..126: Von Heijne matrix score 3.79999995231628 seq PVCLLVLGMAGSG/KT
  misc_feature 224: n=a, g, c or t Oligonucleotide
ctctatggtcgggtgggtggggccaggaggaagatggcggcgtccgcagctgccgctgagctccaggcttctgggggtccgcggcacccagtgtgtctgttggtgttgggaatggcgggatccgggaaaaccacttttgtacagaggctcacaggacacctgcatgcccaaggcactccaccgtatgtgatcaacctggatccagcagtacatgaagttccctntcctgccaatattgatattcgtgatactgtaaagtataaagaagtaatgaaacaatatggacttggacccaatggcggcatagtgacctcactcaatctctttgstaccagatttgatcaggtgatgaaattattgagaaggcccagaacatgtccaaatatgtgt

SEQ ID NO: 635 - DNA, 137 bp, Homo sapiens
  CDS 22..135
  sig_peptide 22..81: Von Heijne matrix score 3.79999995231628 seq VLLTHGLIHYSFT/HH
caacatgcaggtttgttacttatgtatgcatgtgccatgttggtgttattaactcatggactcatccattactcatttactcatcatttacattacgtatttatcctaattcttcccctcccacccccgccacaggg

SEQ ID NO: 636 - DNA, 172 bp, Homo sapiens
  CDS 38..172
  sig_peptide 38..109: Von Heijne matrix score 3.79999995231628 seq SMCLLLDVSSXKS/TD
catcttgtagaaaaaagttacaaattaacaaaaaagaatgggctttcttggcagccccagacagagaaactcaatgtgtttgcttttagacgtcagctctrccaagagcacagataattthcyartcgwwwttttgattatttattatctgattaccagaaaagggccaggg

SEQ ID NO: 637 - DNA, 253 bp, Homo sapiens
  CDS 100..252
  sig_peptide 100..228: Von Heijne matrix score 3.79999995231628 seq FNIFLAAPSPVWQ/PQ
acaagcactgcaatgcagcaaccattgacctaactatgcttccttctccaggtcatctcaagcagacccctcactctgaagcccccggatccaagcaggatgagctgccaamctmagcttgctcdgaccttgacttggctcatgatccgtggaagacatccctacctgacccgtcgatcagcccgaaacttcaacatctttttggcagctccgtccccagtttggcagcctcagaggacccgccgaccccagk

SEQ ID NO: 638 - DNA, 185 bp, Homo sapiens
  CDS 32..184
  sig_peptide 32..133: Von Heijne matrix score 3.79999995231628 seq FHQMALXPGTSRA/QA
acgcggcacacagtcccagtgctcagtcaccatgtgtcctgcatggctcccatgttggacggcacagacggaacatctcgatcgttacaggaagttccaccagatggcgctgtytccagggacatctagggcacaggccttactttataacgaagtcctagagagatttatgttcacccggctgc

SEQ ID NO: 639 - DNA, 206 bp, Homo sapiens
  CDS 73..204
  sig_peptide 73..126: Von Heijne matrix score 3.79999995231628 seq RICTFLLPSHSTS/GP
ttggatgaccttaatgcttcaggacttagtaagaaataagcccgagtacttgtgaaatgttaggctttgttgatgaatgtcatgaagagaatatgtacctttctgttgccttcacactctacctctggccctctgtgctgttcaaatgcccatcttcctgctacctcctctaccttgaaacattgcagggcttggagggaagcgbv

SEQ ID NO: 640 - DNA, 507 bp, Homo sapiens
  CDS 21..506
  sig_peptide 21..383: Von Heijne matrix score 3.79999995231628 seq SLATLPFLSTVVT/DK
  misc_feature 495: n=a, g, c or t Oligonucleotide
aagtcacatgagccaccaaaatggtggtgttcgggtatgaggctgggactaagccaagggattcaggtgtggtgccggtgggaactgaggaagcgcccaaggttttcaagatggcagcatctatgcatggtcagcccagtccttctctagaagatgcaaaactcagaagaccaatggtcatagaaatcatagaaaaaaattttgactatcttagaaaagaaatgacacaaaatatatatcaaatggcgacatttggaacaacagctggtttctctggaatattctcaaacttcctgttcagacgctgcttcaaggttaaacatgatgctttgaagacatatgcatcattggctacacttccatttttgtctactgttgttactgacaagctttttgtaattgatgctttgtattcagataatataagcaaggaaaactgtgttttcagaagctcactgattggcatagtttgtggwgttttctatcccagttctntggcttttacta

SEQ ID NO: 641 - DNA, 483 bp, Homo sapiens
  CDS 295..483
  sig_peptide 295..408: Von Heijne matrix score 3.79999995231628 seq LVVCVSVTVFVWS/CC
  misc_feature 54: n=a, g, c or t Oligonucleotide
accattcggaagaggcggagtcttcttccgaggaccattcggaagaaggcgganctacctctcatcaggaccagtctgactgcacctgcatccttagctcagagcatccccggagcatcttaagagctgagcgcastgacaactaggggccggaccgtcgcaggaggcgtccgctggataccttcccccttccctgacctagagctctacagctgctgcctcggtactgaccgagggttcccagagctgtctyaccattgcaaaaacgttatagcaacagcctctgattacgacatggctgagatcaccaatatccgacctagctttgatgtgtcaccggtggtggccggcctcatcggggcctctgtgctggtggtgtgtgtctcggtgaccgtctttgtctggtcatgctgccrccagcaggcagagaagaagcacaagaacccaccatacaagtttattcacatgctcaaaggcwtcagc

SEQ ID NO: 642 - DNA, 309 bp, Homo sapiens
  CDS 235..309
  sig_peptide 235..279: Von Heijne matrix score 3.79999995231628 seq ILTMLILLIHEHG/IF
attratctatgtgtctgttgttatacgaatatcatgctgttttggtttctatatccttgtaatatgttttgaagtcaggtagtgtgatgcctccagatttgttctttttggtcaggattgctttggctgwtttgggttcwwttwtggttccatacaaattttaggattattttttctatgtctgtgaaaagtggcatgggtattacattcaatctgtagattgctttggatagtatggtcattttaactatgttaattcttttaatccatgagcatggtattttcttttcacttgtttgtgtcctcttc

SEQ ID NO: 643 - DNA, 245 bp, Homo sapiens
  CDS 147..245
  sig_peptide 147..233: Von Heijne matrix score 3.79999995231628 seq LTHTHTCTPPSTA/HP
  misc_feature 61: n=a, g, c or t Oligonucleotide
aacagaccccacccggcacaacctgctcacatacacacacacaataacacacacccaatcnyacgcacccsactcagcataacctgctcacacaatcacacacacaatcacacacaccctacccagtacagcccactcagacacacatgttctcacacaatcactcatacacatacacaccacagcacagcccgctcacacacacacacacatgcaccccacccagcacagctcacccacgcggg

SEQ ID NO: 644 - DNA, 211 bp, Homo sapiens
  CDS 144..209
  sig_peptide 144..188: Von Heijne matrix score 3.79999995231628 seq XMILLCFLAVSNF/NK
atactctttctacattctgctccgctttagctgcgagagtttaccaactcaaatctggcccaagcctggacagtctagataaggaagcggatcacaaaaacaaattggtctgtgtgtgtgtgcgtgcgtgcacgcgcctgtgtatgtttkatatgattttactttgttttttggcagtttcgaattttaataaacttttatggggagvaag

SEQ ID NO: 645 - DNA, 98 bp, Homo sapiens
  CDS 6..98
  sig_peptide 6..83: Von Heijne matrix score 3.79999995231628 seq LPLACFSLFGXLP/QG
ttcaaatgtttttaattttagggaaattttctcgagttatgggtttaccacttgcttgcttctctctctttggcwttcttcctcaggggctccttatc

SEQ ID NO: 646 - DNA, 347 bp, Homo sapiens
  CDS 258..347
  sig_peptide 258..314: Von Heijne matrix score 3.79999995231628 seq LAXLPGXXHGGLS/AV
  misc_feature 294: n=a, g, c or t Oligonucleotide
ctttcttttccggayycagcagtggcgcctaaagtctgcgaggaggaagtcgcctctgtgccccggagttcagaggtctaaggaagaggagataaatatatgaaggtgctgtttggcacagaatttaatagggaagaaagagacagtataactcaccagtgctgggtctcatcatcctgcaatttcdgaacaactatgaatacaaaaagaattttaaaatcccagtcctgcctagaaaggggaagtcatctctaaatatggtggccctggggcagctggcctdcctgccaggcnbctdccatgggggcctttctgcagtgactgtggttcttcccattttactctgt

SEQ ID NO: 647 - DNA, 143 bp, Homo sapiens
  CDS 78..143
  sig_peptide 78..122: Von Heijne matrix score 3.79999995231628 seq VSFVCLLFRNVYS/NL
aaactggggtgagatgatatctcaatgtagttttcatttacatctctaatgatcaataatgttgagcaatttttcatatgcccgtttcatttgtctgtcttcttttcagaaatgtttattcaaatctattgccttcttttttt

SEQ ID NO: 648 - DNA, 232 bp, Homo sapiens
  CDS 41..232
  sig_peptide 41..121: Von Heijne matrix score 3.79999995231628 seq LPLLLPAHHGRHG/SG
aaaaagtgctcgggacaaggmcatagggctgagagtagccatgggctctggaggagacagcctcctggggggcaggggttccctgcctctgctgctccctgctcatcatgggaggcatggctcaggactccccgccccagatcctagtccacccccaggaccagctgttccagggccctggccctgccaggatgagctgccaagcctcaggccagccacctcccaccacttt

SEQ ID NO: 649 - DNA, 133 bp, Homo sapiens
  CDS 4..132
  sig_peptide 4..78: Von Heijne matrix score 3.79999995231628 seq LLGRSGFSFQVSG/WG
actatggcggttggaggaacggcagtgatcacacgtcggctgctgggaagatctggattctcgtttcaggtttcggggtgggggtggggagaaagggtcgatgatttccttttttcgtcgggtatagacggra

SEQ ID NO: 650 - DNA, 419 bp, Homo sapiens
  CDS 317..418
  sig_peptide 317..379: Von Heijne matrix score 3.79999995231628 seq ALSSLAHHPRTSG/QK
ggagtggacacggaggggcctagaggaggcccctagaggggcggaggggccgatggaaagggaaaggtggcctgtcctcccctcccgacaccaggggaggagccccagccccgcgacgaggaggaagcggactgragctgctgaggcagtttgacctggcctggcagtacgggccctgcaccgggatcacacggctgcagcgctggtgtcgggccaagcagatgggcttggagcctcccccagaggtgtggcaggtgctgaagacccaccccggagacccccgcttccagtgcagtctctggcatctctatcccctatgaggcaccacgtaagayctcctgcccttagctctcttgctcaccacccaagaacctcaggacagaagcgagagcccattgctcctgctcagctcagcccgg

SEQ ID NO: 651 - DNA, 396 bp, Homo sapiens
  CDS 52..396
  sig_peptide 52..270: Von Heijne matrix score 3.79999995231628 seq LAGNLALSPTGNA/KK
ttggaagtggtgtggagacggaggacaggagcagtgcccaagcagcgagggatgctgatcttgaatggcttccggggccatgccacagattccgtgaagaactccatggaaagcatgaacactgacatggtgatcatcccagggggtctgacctcacagcttcaggtgctggatgtcgtggtctacaagccactgaatgacagtgtgcgggcccagtactccaactggcttctggctgggaacctggcgctgagcccaaccgggaatgctaagaagccacccctgggcctctttctggagtgggtcatggtcgcgtggaatagcatctcaagtgagtccatcgtccaagggwhcaaagaagtgccatatctccrgcaacttggaggaggaagacga

SEQ ID NO: 652 - DNA, 170 bp, Homo sapiens
  CDS 67..168
  sig_peptide 67..141: Von Heijne matrix score 3.79999995231628 seq YCLSNCLLXXSWG/LH
tgtatacacataaccagatattctcctaagtttttcaaaataatagaaacagatattttgggattcatgatctgtaccactgtttatattaccatggctccttactgtctatcaaactgtttacttthwcawagttggggcctgcatttgtatagatttctagcccccat

SEQ ID NO: 653 - DNA, 178 bp, Homo sapiens
  CDS 131..178
  sig_peptide 131..172: Von Heijne matrix score 3.79999995231628 seq VSLCVAALFPLQA/YG
agagtacctgaaaaccttagagaaccctggggaaatatttatagccaggcttcttggagactctgggaacaggaaagtcaggaaccctgcctttcaggaactgctgtatctcagtcggcttcttcatttcatggtttctctctgtgtagctgctttatttcctcttcaggcttacggg

SEQ ID NO: 654 - DNA, 121 bp, Homo sapiens
  CDS 36..119
  sig_peptide 36..107: Von Heijne matrix score 3.79999995231628 seq FVYLLLRNLXSYS/LP
tgtggttttgattggcatttccctgatcattactgatgttgagcattttttcatttttttgtaggccatttgtatatcttcttttgagaaatctckrttcatattctttgcccaccacggg

SEQ ID NO: 655 - DNA, 370 bp, Homo sapiens
  CDS 89..370
  sig_peptide 89..319: Von Heijne matrix score 3.79999995231628 seq LGLQCDAVNLAFG/RR
acttcgccattttcctccggaagtgcggatcccagcggcggtcgtgtagctgagcagscctggggcttggttctatgtccctgtggctatgtttccagtgtcctctgggtgtttccaagagcaacaagaaacgaataaatctctgccccgcagcgcctccaccccagagacccggaccaagttcacacaggacaatctgtgccrygcccagcgcgagcgcctggactcggccaacctgtgggtkctkgtggactgcatccttcgcgacacctccgaggacctgggactccagtgtgacgccgtgaacctggccttcgggcgccgctgtgaggaactggaggacgcgcggcacaagctgcagyaccacctg

SEQ ID NO: 656 - DNA, 197 bp, Homo sapiens
  CDS 137..196
  sig_peptide 137..181: Von Heijne matrix score 3.79999995231628 seq LVHSFLWLSSILY/IY
attgtatcgttcttatgcctttgcatcctcatagcttagctcccacatatcagtgagaacatacaatgtttggttttccattcctgagttacttcacttagaataatagtctccaatctcatccaggtcactgcaaatgccattggttcattccttcttatggctgagtagtatcctatatatataccacctgcggg

SEQ ID NO: 657 - DNA, 246 bp, Homo sapiens
  CDS 79..246
  sig_peptide 79..150: Von Heijne matrix score 3.79999995231628 seq XVFXFXFLXRXLX/XX
tttttgacatcytattaatagccattctggctggtgtcaggtggtatctcattgtggtttcgattttggatttctctaatgattagtaatggtaagtttttttgtttttttttkgtttttkgtttttkgtttttgaracggasyttgcyctkgycgcccaggctggagtgcaatggmaarayctcggcycactgmaacctccgcctcctgagtycaagcaattcyctkgcctcagccccccgaggg

SEQ ID NO: 658 - DNA, 335 bp, Homo sapiens
  CDS 31..333
  sig_peptide 31..300: Von Heijne matrix score 3.70000004768372 seq LRVRLTLPHSIRS/DS
  misc_feature 320: n=a, g, c or t Oligonucleotide
acacgcgcctcttcacgaggtggaaacaagatggaggattcggcctcggcctcgctgtcttctgcagccgctactggaacctccacctcgactccagcggccccgacagcacggaagcagctggataaagaacaggttagaaaggcagtggacgctctcttgacgcattgcaagtccaggaaaaacaattatgggttgcttttgaatgagaatgaaagtttatttttaatggtggtattatggaaaattccaagtaaagaactgagggtcagattgaccttgcctcatagtattcgatcagattcagaagatatctgttnatttacgaaggatgg

SEQ ID NO: 659 - DNA, 197 bp, Homo sapiens
  CDS 20..196
  sig_peptide 20..106: Von Heijne matrix score 3.70000004768372 seq LIELNLXSPVALQ/WP
attcaacaagcaatcaggtatgaatgcagaaggggcttccccaggaaaagaaacgaacacaggaacattgatagagctaaatctgmccagccctgtagccctccagtggccactttccagcccctcttgcctgaggatcctcagcaacaaggtgcccaggaacctgaggtggcagaaacactactccacccaccagg

SEQ ID NO: 660 - DNA, 272 bp, Homo sapiens
  CDS 28..270
  sig_peptide 28..216: Von Heijne matrix score 3.70000004768372 seq MAAAAALRAPAQS/SV
attttggcctgtcaggtccatccggcgatgctgggtctggacgagctcgggaggagtggttgtggccattgcacacaggcggatctgaggttcggcgacgccgctggycscgaaccccgggmcaggmcaacgcacaggaacaccgccgcagcccgcgttccccccccgcccagagtcatggcggcagcagccgctctgagggcgcctgctcagagcagtgtgacctttgaagatgtggctgtaaacttttccctggaggaatggagtcttct

SEQ ID NO: 661 - DNA, 411 bp, Homo sapiens
  CDS 263..409
  sig_peptide 263..340: Von Heijne matrix score 3.70000004768372 seq WGNLSFHLQEAHG/SE
tgaaaacaaacatctactaatgttgtcagatggttaggaagcaagattctgcaactatagagggtaagtgtttctttggttctgtgggtcctctctaaaactctaagatcttgaggggtgcatttcagaaagtgcagcgtgacccgcagtttgtgggaagccatggagctcggcactgccatcctaatacttcctaaagcacaaaaccccagagacaatctggggtcaggagagtggaaggggcttgtctgccacactggtgatgagtgccctgaaagacttcagagaatttctgaactggtggggaaacctctcttttcatcttcaggaagctcatggaagtgaaattgcagaaatgggagctggtattctagaggaaaaaaattatggvcaacaawatcactgtaacta

SEQ ID NO: 662 - DNA, 146 bp, Homo sapiens
  CDS 38..145
  sig_peptide 38..127: Von Heijne matrix score 3.70000004768372 seq PPSLFLSLPPSLS/PP
awbwcccgcccacacgtggccaacctttgcgtttttaatgtctctwcccccttttttccacccttctcccgctccctctctcgctccccctccctccctctttctttccctccctccctctctttctccccctctacccgcccggg

SEQ ID NO: 663 - DNA, 65 bp, Homo sapiens
  CDS 10..63
  sig_peptide 10..48: Von Heijne matrix score 3.70000004768372 seq MFFLCGFLYLCFI/SF
caatatgctatgtttttcctttgtggttttctgtatctatgttttatctcatttttttttttttt

SEQ ID NO: 664 - DNA, 182 bp, Homo sapiens
  CDS 30..182
  sig_peptide 30..155: Von Heijne matrix score 3.70000004768372 seq ALGIFLCPGETLS/AS
cgggatgccggagccctcgggccttggagatgaaggcaggcccctgctcctgccaggagggagggaggcagtgggctcatgggtcggtgcctttgcagccgacagcacgccttgcggccctggggatctttctgtgccccggcgagaccctttcggcctcactgcattggaaccccattggg

SEQ ID NO: 665 - DNA, 320 bp, Homo sapiens
  CDS 160..318
  sig_peptide 160..228: Von Heijne matrix score 3.70000004768372 seq TNLLCLTFQRCQS/YN
tacatcagaaaccagaggcggaaaactttccacggtgatatgcataaacaaatatttcatattttttacagaaagtctggctattgcctatagaaagacaaaaactggtaacagccttattccagctaaatttgaatgccaggttgacactaatcatggatgctttcccagagctttcagaaaaacaaaaccaacctgttgtgtttaactttccaaagatgtcagagttacaattggctgaatatttttgaagctacatatatgacgactctcttcatttcagtaattaamacaaattttttaaaaagatacctcctggg

SEQ ID NO: 666 - DNA, 273 bp, Homo sapiens
  CDS 180..272
  sig_peptide 180..254: Von Heijne matrix score 3.70000004768372 seq QLLGCMVLYDCFS/FK
aagttgttgcatgtgtcaatggttgttcctttttatttctgagtaatgttccatgatatgaatgtaccacagtttgtttaaccattcacccactgaaggacgtttggattgtttctaagttttgactgtggcaagtaaagatgctatgaacattcatgtacacatgaatttgtaggcatatgtttttattttgctgggagaaaagcccaagaatgcagttgctgggttgtatggtattgtatgattgtttttcttttaagaaactgccggggg

SEQ ID NO: 667 - DNA, 149 bp, Homo sapiens
  CDS 8..148
  sig_peptide 8..97: Von Heijne matrix score 3.70000004768372 seq FVCFFHVFYCVFC/NV
attttgtatgtcttttatatctgttatttttcctttaatccttttaaaccgtttttcatttgtttgtttctttcatgtcttttactgtgttttctgcaacgtctcttctttgttctcctatcagtttcttcttcatttctgtgatgact

SEQ ID NO: 668 - DNA, 122 bp, Homo sapiens
  CDS 16..120
  sig_peptide 16..108: Von Heijne matrix score 3.70000004768372 seq LGMGMGFFSGVKS/WI
caaggaattacagaaatgcatgaatacttacctagaaactttcatgactttaattctcccaactctaaattaggcatgggaatgggctttttctcaggtgtcaaatcttggattggaggtga

SEQ ID NO: 669 - DNA, 288 bp, Homo sapiens
  CDS 38..286
  sig_peptide 38..145: Von Heijne matrix score 3.70000004768372 seq ILMRDFSPSGIFG/AF
tcgcgcggtcccgcacagcggacaccaggactccaaaatggcgtcarttgtaccagtgaaggacaagaaacttctggaggtcaaactgggggagctgccaagctggatcttgatgcgggacttcagtcctagtggcattttcggagcgtttcaaagaggttactaccggtactacaacaagtacatcaatgtgaagaaggggagcatctcggggattaccatggtgctggcatgctacgtgctctttagctactccttttcctacaagcatctcaagcacgagtcggg

SEQ ID NO: 670 - DNA, 160 bp, Homo sapiens
  CDS 89..160
  sig_peptide 89..142: Von Heijne matrix score 3.70000004768372 seq GALLWMAWDGQLS/RP
cgtcaacattcttttcattctgggcctgagcgcgtggatcaagccgctgcccttgcaactgctgagcctgaagctggacttgccggtgatggtgatatcggccggggcactgctgtggatggcgtgggacggccagctcagccgccccgaaggcgcccgt

SEQ ID NO: 671 - DNA, 137 bp, Homo sapiens
  CDS 44..136
  sig_peptide 44..97: Von Heijne matrix score 3.70000004768372 seq LELLGSSYNPISA/SP
gaattttcttcttctgctcaggctggagtacaatggcacaatcatggttcactgtaatcttgaactcctgggctcaagttataatcccatctcagcctctccagtagctaggactatatcatgccccgctattgtgg

SEQ ID NO: 672 - DNA, 493 bp, Homo sapiens
  CDS 111..491
  sig_peptide 111..374: Von Heijne matrix score 3.70000004768372 seq CDLLLARFGLIQS/MK
gcccgcgcttgttgtgctgaggccgagggagtcgccattttggatggtgaaccctgaagtcggtgtctgctgcgttcacggcaggattcggttaggaggaacagcacagcatgctgggctctggatttaaagctgagcgcttaagagtgaatttgagattagtcataaatcgccttaaactattggagaaaaagaaaacggaactggcccagaaagcaaggaaggagattgctgactatctggctgctgggaaagatgaacgagctcggatccgtgtggagcacattatccgggaagactacctcgtggaggccatggagatcctggagctgtactgtgacctgctgctggctcggtttggccttatccagtctatgaaggaactagattctggtctggctgaatctgtgtctacattgatctgggctgctcctcgactccagtcagaagtggctgagttgaaaatagttgctgatcagctctgtccaagtat

SEQ ID NO: 673 - DNA, 263 bp, Homo sapiens
  CDS 102..263
  sig_peptide 102..230: Von Heijne matrix score 3.70000004768372 seq VWCLXLKLVPALC/IS
tcccagcagaagggyyagcgcctggctgtcagcagcgtgtgcctcaggagggatctgcggtgacggggttgttacttcagtaggatgaggaagagtcacaaatgcggggttggmmggctcctgcttggagasghytgarcacyaggagactaccaatggggagcaggcacggtgccagcccggcctctgccgtctggtgtctgtmcctcaagttagtcccagctttgtgcattagcgggctcaccctcggaatccagggattc

SEQ ID NO: 674 - DNA, 263 bp, Homo sapiens
  CDS 115..261
  sig_peptide 115..216: Von Heijne matrix score 3.70000004768372 seq RLTILXFHDNTWG/ST
  misc_feature 136,139..140: n=a, g, c or t Oligonucleotide
gtcatttatgccatattctgtccactagaaatgaattactaagtctggcccaaactcaagtggaggcgaattaagctgcatctcataagggaaagagtatcgaagaacttctgtatgtattttaaaaccactacantannbcatagtgcacatatgcttctgcaaatttgcttttttcgcttaacaatcttagktttccatgacaatacatgggggtcaacttcattctcttwagttgckgcaatgctattccactaccgggg

SEQ ID NO: 675 - DNA, 107 bp, Homo sapiens
  CDS 30..107
  sig_peptide 30..101: Von Heijne matrix score 3.70000004768372 seq LLFLFFLFLFFFF/FF
tgcactggcacacactcacagctctgaccatgtcatcaaacatacagagactgggcttccctctgctttttcttttttttctttttctttttttttttttttttttt

SEQ ID NO: 676 - DNA, 276 bp, Homo sapiens
  CDS 70..276
  sig_peptide 70..270: Von Heijne matrix score 3.70000004768372 seq LVLPLPMLPTSNR/KR
gtcacagcaccctcctgaaaactgcagcttccttctcaccttgaagaataatcctagaaaactcacaaaatgtgtgatgcttttgtaggtacctggaaacttgtctccagtgaaaactttgatgattatatgaaagaagtaggagtgggctttgccaccaggaaagtggctggcatggccaaacctaacatgatcatcagtgtgaatggggatgtgatcaccattccccacctggtcctcccccttcccatgctgccaacttctaaccgcaagagg

SEQ ID NO: 677 - DNA, 441 bp, Homo sapiens
  CDS 337..441
  sig_peptide 337..399: Von Heijne matrix score 3.59999990463257 seq GQLLSFLLGTYLG/RR
gggattcaaggaggcccatcatgtcagaatgctgtgggttggcaggaggcatcacaatgaaattttccatgttcccaaatttgatattcacagtactacatataatttctcagggaagatagggttggacacgatggaaatattttggtgaaccattcgttcccttgggtttctttctcatttggggagtgtggtttacaatgattggagcaaaagtttcctgaatctttttcttgtttccattttattgcatggtaaaacacaatttatccactttcttgtcaatgagtatctagttagattcctgttttttggctaattcaaataaaactatgaatgtttttgtaccggtcttttggtgggcagttgctttcctttctcttgggtacatacctaggaaggagggaagttgctgggccacagcatggccagttttctaaa

SEQ ID NO: 678 - DNA, 191 bp, Homo sapiens
  CDS 135..191
  sig_peptide 135..182: Von Heijne matrix score 3.59999990463257 seq FFCLCAFNSFLLS/PE
aagtgtgtgttgctgcggcascacggaggccaaggacctcacggkwstaaaagatgacgagactggcttcgggagaaacaccatccagaagagacctttcaaaaaacttctagagactccccaagacgtatgagatgamaggcttcttctgtctgtgtgcgtttaactcatttctccttagccccgagggg

SEQ ID NO: 679 - DNA, 235 bp, Homo sapiens
  CDS 31..234
  sig_peptide 31..228: Von Heijne matrix score 3.59999990463257 seq LTSFLSIXIFVNP/TR
atttttcaccactgcatagtgttacattgtatgattttcccacattgcatgtactgtttagagtgtataactaagaatggattgctaggtttaaaggtgcttccactctatgggataatgctaatttttttccctaaagtggtttataacaatcaacccttgcactacaagtcagtaatggtgtttcagttgacttcattcttgtcgatttkaatttttgtcaaccccactcggg

SEQ ID NO: 680 - DNA, 410 bp, Homo sapiens
  CDS 173..409
  sig_peptide 173..334: Von Heijne matrix score 3.59999990463257 seq LMAXLLTVEVTHP/NS
  misc_feature 305: n=a, g, c or t Oligonucleotide
taatcgaaaagctcagtgcgcaggcgcgaagaagctggcaggggcacgagccgggggcgggtttgaagacgcgtcgttgggttttggaggccgtgaaacagccgtttgagtttggctgcgggtggagaacgtttgtcaggggcccggccaagaaggaggcccgcctgttacgatggtgtccatgagtttcaagcggaaccgcagtgaccggttctacagcacccggtgctgcggctgttgccatgtccgcrccgggacgatcatcctggggacctggtacatggtagtaaacctattgatggcanbtttgctgactgtggaagtgactcatccaaactccatgccagctgtcaacattcagtatgaagtcatcggtaattactattcgtctgagagaatggctgataatg

SEQ ID NO: 681 - DNA, 303 bp, Homo sapiens
  CDS 21..302
  sig_peptide 21..113: Von Heijne matrix score 3.59999990463257 seq STFALTIXRXXSC/SS
  misc_feature 102: n=a, g, c or t Oligonucleotide
gagttkgactgtgaagaaacatggcggccgcgacgttgacttcgaaattgtactccctgctgttccgcaggacctccaccttcgccctcaccatcakccgtngggsgtcatgttcttcgrgcgcgccttcgatcaaggcgcggacgctatctacgaccacatcaacgaggggaagctgtggaaacacatcaagcacaagtatgagaacaagtagttccttggaggcccccatccaggccagaaggaccaggtccacccagcagctgtttgcccagagctggagcctcagcdtgaagatgatgc

SEQ ID NO: 682 - DNA, 328 bp, Homo sapiens
  CDS 79..327
  sig_peptide 79..201: Von Heijne matrix score 3.59999990463257 seq LHTSVTLFLLSYC/DC
  misc_feature 258: n=a, g, c or t Oligonucleotide
agatgattccctgattctccagagagattacacacttcgtttgtggctaaggttactgtgacccaatgaaagaagaaaatgaaagccataaagaaaagtcttacagaagaagaatacctgtacctggacttttctcaccaaacagaaggatgcatctttcctcttcatacatctgtaactttatttctgttatcttactgtgactgtaaaatctttaaaatttgcttagttgtcaccaaagaggtgagtagagatavntcactactaagagatgacctgatccaggatgttgaaatacagattatttcaaggcaggagctcccaccaa

SEQ ID NO: 683 - DNA, 447 bp, Homo sapiens
  CDS 386..445
  sig_peptide 386..427: Von Heijne matrix score 3.59999990463257 seq FLCVCYFIRKSTS/FF
  misc_feature 307: n=a, g, c or t Oligonucleotide
ttaacatcttccactgaaaagaaaagataatgatataaataaagcaatttaaatcaagtctaaggtataggaaggtatttaagaaagaagcaaacattctctagatgttgttatccaaaatatattctcttttgcagtttactgaaataatttcttcagtgtgtgggaatttcctttgcatccagctttactatagagatgacatcacaccaacagtgacacgacttgtttacaagagggtggtataaacagcaaatgttcttccttaaaacagatttcttgttgaacttcaacagaaaaagaagcngtaaatgtagaaggaagaacaggagatagtctttaacatgtagggtaaaatctaaggtagaggagagagcagctgataatgtttttatgtgtttgctactttattaggaagtctacttccttcttttccatatctagtag

SEQ ID NO: 684 - DNA, 217 bp, Homo sapiens
  CDS 5..217
  sig_peptide 5..139: Von Heijne matrix score 3.59999990463257 seq AWWLLLPVWKLGG/QL
tcaaatggggaagccgagaggtggtgagatgcttgaggttgtaaagactgtctccactttcactttgggagggtggaaagggactgctcctgtgtcctgcgcctggtggctgcttctcccagtttggaagctgggagggcagcttgagcgcaggaagaatccaaaggaatactgtcttggctcctgggtgtggctcagtcctcagctggctccaagg

SEQ ID NO: 685 - DNA, 132 bp, Homo sapiens
  CDS 77..130
  sig_peptide 77..124: Von Heijne matrix score 3.59999990463257 seq FTFISTLLFVFLG/VV
tgaaatcctagcttgaatatttacattagtcttgtttctcaaacttgactctttggtttgatcgacattttccctaatgctgattttcacctttatttctactttgctgtttgtattcttgggagttgtggg

SEQ ID NO: 686 - DNA, 260 bp, Homo sapiens
  CDS 120..260
  sig_peptide 120..230: Von Heijne matrix score 3.59999990463257 seq PGSGLCSMAAVQA/GN
acatctccttggccccgccccactcccgcggggctattgtccccggtaaactgcagtttctggttcgagactccaatcctgtttcgaattgctgcttgctgccccttgggctggggataatggaagttctttcbmttcccaactctttccagacccaagcactctgggactcactccatagtccaggagttccaggttccggattatgttccatggcagcagtccaagcaggaaaccaagccatctactctgcctcgggg

SEQ ID NO: 687 - DNA, 473 bp, Homo sapiens
  CDS 332..472
  sig_peptide 332..457: Von Heijne matrix score 3.59999990463257 seq LLTQAGFPRRGEA/AP
tgtgtatgtgtgaaaatcaggaagagccagcggggagtgtgtgttgccatcgcgtctccgcctgcaggggcgggaccccaggaggagggagaggacagagccactgcagaggaccagactgggaaaacaacgatatggcaggagccagtcttggggcccgcttctaccggcagatcaaaagacatccggggctgggacagaaagaacaacccggagccctggaaccgcctgagccccaatgaccaatacaagttccttgcagtttccactgactataagaagctgaagaaggaccggccagacttctaagccaggctgggctgccagtgccatgcaagccacagccagccagcccatccacttcttccrstcctccccgcaggccccaaggcatcactccggccaccctgtcccgctactgcttacacaggccgggttcccacgcagaggggaggctgctccacccctactcc

SEQ ID NO: 688 - DNA, 107 bp, Homo sapiens
  CDS 5..106
  sig_peptide 5..94: Von Heijne matrix score 3.59999990463257 seq LCTFTLNLTAVRT/IX
acacatgcgagggtakaactghgtgttcagggttttctctgaaagcctgaagggattgtgtacwtttacattgaacttgactgcagttagaaccattarcctagatg

SEQ ID NO: 689 - DNA, 377 bp, Homo sapiens
  CDS 258..377
  sig_peptide 258..353: Von Heijne matrix score 3.59999990463257 seq RLTISTXLSTSXX/FM
aaacacaacaaccagattcctcctctaaagaagcccctgggagcacagctcatcaccatggactggacctggaggttcctctttttggtgacagcagctacagatgtccagtcccaggtccagctggtgcaagtctgggtactgaggtgaagaggcctgggtcctcggtgaaggtctcctgtaagacttctggaggcaccttcagtagtaatgccatcacgtgggtgcgacaggcccctggacaagggcttgagtggatgggraggatcatccccatggttgaaaaagcggacaccgcacagaagttccagggcagactcactattagtacadkvctatcgacgagcasagscttcatggaactgagcagtctgaga

SEQ ID NO: 690 - DNA, 388 bp, Homo sapiens
  CDS 53..388
  sig_peptide 53..253: Von Heijne matrix score 3.59999990463257 seq IIMVFVFICFCYL/HY
ataaattcagtagttaccttagtagacaaatcatttgaaccaagttgcggacatgaatcttgttatttgtgtcctacttttgtccatttggaaaaataattgcatgactacaaaccaaaccaatggatcttctactacaggagataaacctgttgaatcaatgcagacaaaattgaactaccttagaagaaatctactcattttagttggtattatcatcatggtttttgtctttatctgtttttgttatctccattataattgtctgagcgatgatgcgtccaaagcaggaatggtcaagaaaaaaggcatagcagccaagtcatctaaaacatcattcagtgaagccaagacagcctctcaatgcagttcagaaacacaaaccggg

SEQ ID NO: 691 - DNA, 408 bp, Homo sapiens
  CDS 304..408
  sig_peptide 304..387: Von Heijne matrix score 3.59999990463257 seq IFFSLTLSGCKFS/KL
cttgacttctgtgcactcacaggcttgatcaacaccacaaggaagctgccaaggccatcctctgaaaccacagcccgagctctatgttggccccttttagccatggctggaatggctgagacacaggacaccaagtccctaggctgtacacagcactgggaccctgggccctgcccatggaacaattttttcctcctaaatcttcaggcctgtgatgggaggggctaccgcaaaggtctctgacatgccccagatacattttccctattgtcttggggattaacatttggctcctcgttacttatgcaaatttctgcagccagcttgaatttctcctcaaaaaatggaattttcttttctttaacattgtcaggctgcaaattttccaaacttttatgcccttttggg

SEQ ID NO: 692 - DNA, 322 bp, Homo sapiens
  CDS 106..321
  sig_peptide 106..261: Von Heijne matrix score 3.59999990463257 seq LVWDCLLPPPSFF/LL
  misc_feature 284..285: n=a, g, c or t Oligonucleotide
tgttacctgtgtgcatatattatatctacttaagttttattctaaataaggagcttgtgatarttgtttccgttttgtaattagaaggtattatatgttcctatcatgatttttgagcctgtggttctgaaaccagtgtttctaaatatttttttcttttcacatcatgtatttacagtgtttttcagtggtagtcatgttgacatcctgagtcgcacagttcttgtttgggactgtcttcttcctcctccttccttcttcctccttcttctttcttcttcctnntccttvctcctccttvctdcttcttcctcctcccggg

SEQ ID NO: 693 - DNA, 153 bp, Homo sapiens
  CDS 93..152
  sig_peptide 93..134: Von Heijne matrix score 3.59999990463257 seq LVPLLSHLLFKFT/WP
cttttttagtaggggagcttgataatggaaaacagtatgaggaattgtcacactgtatgagattttaaactaaggcataagaatgaaaccggatgttagttcctcttttatcacacttgctcttcaagtttacctggccaaaatkgtcccagg

SEQ ID NO: 694 - DNA, 234 bp, Homo sapiens
  CDS 23..232
  sig_peptide 23..169: Von Heijne matrix score 3.59999990463257 seq FGVLSGLXQXVSP/GK
aagcgcgggacgcwrcaaagtcatggaccgcaacccctcgccgccgccgccgggtcgcgacaaggaggaggaggaggaggtggccggtggagactgcatagggagcacggtctacagcaaacactggctcttcggcgtcctcagcggactcakccagrttgttagccctggaaaacaccaaaatctaggctcagrtgmtgaggagcagctgacggagcttgatgaacgaaatgg

SEQ ID NO: 695 - DNA, 455 bp, Homo sapiens
  CDS 344..454
  sig_peptide 344..412: Von Heijne matrix score 3.59999990463257 seq LGCHFFSLALLNT/GP
  misc_feature 285,342..343: n=a, g, c or t Oligonucleotide
tgttatatgggtctcttgaagacaatatacagttgggtctttcttctttattcaacttaccactctgtgccttttaagtggggcatttagctaakwtacattcaaggttaatattgatatgtgcatatttgatcctgtcatsatgttamctggtcgttattcagactagattgtgtagtttttttatagtgtgtcagtagttacgttttgtggtggtcagtgacagtgatttttttccccatgtttagcatccctttaaggacctattgtaaagcaggtctagtngtaacaaatttccttggcatttacttatcaggaaaggatctttttttctcctttgcnnatgaagcttagtttggctggatatgaaattcttggttgtcatttcttttctttagcactgctaaatacaggcccccaatatcttttggcttatagggtttctgctgaaaggt

SEQ ID NO: 696 - DNA, 153 bp, Homo sapiens
  CDS 8..151
  sig_peptide 8..127: Von Heijne matrix score 3.59999990463257 seq ITALSQSLQPLRK/LP
agacaagatggcgacgtccgtggggcaccgatgtctgggattactgcacggggtcgcgccgtggcggagcagcctccatccctgtgagatcactgccctgagccaatccctacagcccttacggaagctgccttttagagcctctygcacggg

SEQ ID NO: 697 - DNA, 493 bp, Homo sapiens
  CDS 116..493
  sig_peptide 116..262: Von Heijne matrix score 3.59999990463257 seq YCLVTLVFFYSSA/SF
aaaagctgacgacttcggtctgcgccggaagtgcatgagctgccgatgtggtgcttagtgattgcggtttcggtcgctctcccgtgtttcccgggctgggtatttgcctcgcaccatggcgcccaagggcaaagtgggcacgagagggaagaagcagatatttgaagagaacagagagactctgaagttctacctgcggatcatactgggggccaatgccatttactgccttgtgacgttggtcttcttttactcatctgcctcattttgggcctggttggccctgggctttagtctggcagtgtatggggccagctaccactctatgagctcgatggcacgagcagcgttctctgaggatggggccctgatggatggtggcatggacctcaacatggagcagggcatggcagagcaccttaaggatgtkatcctactgacagccatcgtgcaggtgctcagctgcttctctctctatgtctggtccttctgg

SEQ ID NO: 698 - DNA, 174 bp, Homo sapiens
  CDS 8..172
  sig_peptide 8..94: Von Heijne matrix score 3.59999990463257 seq AFNKAVWFTPCSC/QE
aacaaagatggcggcggtgactgtgacggtgacgaagacggcggcggcggcgacggcatttaacaaggcggtgtggtttactccatgcagttgtcaggaggtaagtagcaggctgccggctcggacggcggcgacgcggcaggacagggcggataagaaggagcggccctgtgg

SEQ ID NO: 699 - DNA, 300 bp, Homo sapiens
  CDS 199..300
  sig_peptide 199..255: Von Heijne matrix score 3.59999990463257 seq PGSAICLWHSTLG/GX
  misc_feature 261: n=a, g, c or t Oligonucleotide
attttgtctcggcagcggtggccgwagctccatcgcattttatgtttctggcgagaagggaacggagttttcatcaggtagattggtttttrtgcggccgtcctccaccgtttcctccaggacagcacctagtcgtggccggaggagtctcatagctgtcagaaagaataagactgattttatgggaaaattaagcagatgctccagtttgagaaacctggatctgcgatctgtttgtggcacagcactttgggaggyymnggcgggcgtgagattgdsagtttgagaccagcctgcggg

SEQ ID NO: 700 - DNA, 159 bp, Homo sapiens
  CDS 86..157
  sig_peptide 86..139: Von Heijne matrix score 3.59999990463257 seq LAILLKWVSNSKS/FL
ttttatagctatcacaaatgagattgctttcttaattttttttcagattaatcatagttaacaaatagaaactattgattttygtatgttgatttcgtatcttgcaattttactaaaatgggttagcaattctaagagttttttggtgaaggcatcggg

SEQ ID NO: 701 - DNA, 274 bp, Homo sapiens
  CDS 46..273
  sig_peptide 46..90: Von Heijne matrix score 3.59999990463257 seq LQTLAFWSAYVPC/QT
agtgtgtccggaattggtgggttcttggtctcactgagttctagaatgaagctgcagaccctcgcattctggtcagcctatgtgccatgccagacccaggaccgggatgccccgcgcctcaccctggagcagattgacctcatacgccgcatgtgtgcctcctattctgagctggagcttgtgacctcggctaaagctctgaacgacactcagaaattggcctgcctcatcggtgtagagggtggccactcgctggacaatagcctctccaggg

SEQ ID NO: 702 - DNA, 175 bp, Homo sapiens
  CDS 107..175
  sig_peptide 107..148: Von Heijne matrix score 3.5 seq PACLSSFVIPSLL/SP
ttgctttctaagacacttactttcatcggcactttcagatttttgaattatactttctcaatttgatttttcaagtgagttattaggatataggtgggagtggagaatgcctgcctgcctttcttcctttgtcattccctctctcctttctccctcctcccctccctccataggg

SEQ ID NO: 703 - DNA, 298 bp, Homo sapiens
  CDS 197..298
  sig_peptide 197..244: Von Heijne matrix score 3.5 seq SFAGSCTILGASS/HS
ttttcatgtgtctgttggctgcataaatgtcttcttctgagaagtgtctgttcatatccttcgcccacttgttgatgaggttgtttttttcttgtaaatttgtttgtgttcattgtaagttctggatattagccctttgtcagatgagtagattgtaaaaattttctcccattctacaggttgcctgttcactctgatggtagtttcttttgctggttcttgcacaattctaggcgccagtagccattcattccccattgaagtcagcctgttcccagtggactgtggcttcctcttg

SEQ ID NO: 704 - DNA, 136 bp, Homo sapiens
  CDS 41..136
  sig_peptide 41..100: Von Heijne matrix score 3.5 seq AVSQSWLAAPSTS/WV
ttcttattaaagatttatttttgtagagacagatgtctcaatgtgttgcccaggctggaacgcagtgtcgcaatcttggctcgctgcaccttccacctcctgggttcaagagattctcgtacttcagcctccaggg

SEQ ID NO: 705 - DNA, 433 bp, Homo sapiens
  CDS 225..431
  sig_peptide 225..386: Von Heijne matrix score 3.5 seq IRCPLIFLXXVSG/TX
agaggactaygcgagagcgtctacggttgtgccaaaggaaaaaaaatgttcctaagaaaagagtatacaaagttgtgttcatcaaagtctggaacccaaaggtgtccctccaaagctgtacacgacagagaaaacgcgaactgaaagaagaagcaggtcccaaggggccaggcgcctcctccacctcctcctcctcctaggattaacctccatttcagctaatcatgggagagattaaagtctctcctgattataactggtttagaggtacagttccccttaaaaabdtwatkgtggatgatgatgacagtaagatatggtcgchctatgacgcgggcccccgaagtatcaggtgtcctctcatattcctgcycyctgtcagtggaactghagatgtctttttccggcagattttggctctgactggatgggg

SEQ ID NO: 706 - DNA, 419 bp, Homo sapiens
  CDS 284..418
  sig_peptide 284..331: Von Heijne matrix score 3.5 seq SHSHLSLVGHSRA/CG
attgaaaatcattaaaaatcttagcaattgttttaaattatctaatttttttctccaaataatatctattttagcagccaaatcaccacaaatcattggtttttatctttagttgtgggtgcacagcgggtgcgtgtattttggggcatgtgaggtgtcttgatgcgttcatgcagtgtgtaacagtcacatcagggtaaatgggacatctttcacctcaagcatttatccttcgtgttatggacaccctcagctggaaaggggggctgcgtcgtgagtatgaatggatgcaagtcatagccacctgagcctggtggggcacagcagggcctgtggagtcacatcccggcctcatgctcggcataggggacgctgcttaggtccatgcagtcgctcagggcccaggctgtgcagcgcca

SEQ ID NO: 707 - DNA, 382 bp, Homo sapiens
  CDS 200..382
  sig_peptide 200..301: Von Heijne matrix score 3.5 seq LISHDPWPRGAFA/LS
  misc_feature 365: n=a, g, c or t Oligonucleotide
gttacttatggttgagagagaatatttttcagattttattggacattgatatttgtaaattgttcattccttttgcccagttttctattgagtggttcatagtttctcatgggtatccaagagttctggatatgtagaggtggagggtcaatctcatcayttccttgttttaaaaatcttccatggttttgtcatcactatgggctcaaacgccgtggtgtggcatacaaagccctcacttctgaaccaccctgcttccagcctcatctcccatgatccctggccacgcggtgcgtttgcgctttcatgtccaagtgcttccttcatgttgttttcttccttacaatgccctttcccttattgdnaaacagagtgcaacgwg

SEQ ID NO: 708 - DNA, 384 bp, Homo sapiens
  CDS 215..382
  sig_peptide 215..268: Von Heijne matrix score 3.5 seq ACLFRAVADQVYG/DQ
aagtgacgctacaggggccagctatgctcccgggagtgttgatgttttccagtcattccggctgacagcgttcaagttggaatcctggaggggaggtgtttttcctgtcgtacgtgggacaggccacgctgtccgtccgcagtaccgacgcctgcagcaggagcattggtttgaaaaggccctacgagacaagaagggcttcatcatcaagcagatgaaggaggatggcgcctgtctcttccgggctgtagctgaccaggtgtatggagaccaggacatgcatgaggttgtgcgaaagcattrcatggactatctgatgaagaatgccgactayttctccarctatgtcacagaggactttaccacctacattakcaggaagcg

SEQ ID NO: 709 - DNA, 149 bp, Homo sapiens
  CDS 76..147
  sig_peptide 76..138: Von Heijne matrix score 3.5 seq VLIMIXEAXNVWC/GD
  misc_feature 123..124: n=a, g, c or t Oligonucleotide
acctaatattaaaaatcttcttctctaaaagtggcatataaccctgatcaagaggtcatgggctcagtttgatatatggttcacctcattcttactgaagtcctcattatgatcakcgaggcnnsgaatgtgtggtgtggggattcggg

SEQ ID NO: 710 - DNA, 167 bp, Homo sapiens
  CDS 15..167
  sig_peptide 15..155: Von Heijne matrix score 3.5 seq CLXFGILASEVYS/WN
atatttcatggcgaatgtaccacaatttatttgctctgttgttgatagacattcatgttgttctagttttttactgcctggatctcttaatgattcatattttctattgtaaatactgccttgkatttggkattttagcaagtgaagtctattcttggaacatttac

SEQ ID NO: 711 - DNA, 215 bp, Homo sapiens
  CDS 84..215
  sig_peptide 84..170: Von Heijne matrix score 3.5 seq SPLCSXSSGYCXA/FP
ccgcttttggctgcatcagccggggattgccggcgccaggtgctgggggcgactcggacagcgggagcgtggggtggagtaggatggagtctccctcccgagctgggggtgtrgrcctmvgaaaggctgcttcgccgctgtgttcggmvagctctggatactgcrgggcttttccgcggaggagcgcccgccggcatctgcatccgggacacggg

SEQ ID NO: 712 - DNA, 241 bp, Homo sapiens
  CDS 59..241
  sig_peptide 59..133: Von Heijne matrix score 3.5 seq LISLSVLMPVQHS/PD
actatcctttcctcattgaattgctgtgatacctttgttgcaaatcagctgtctgcagatgtggaggtatgtttctagactttcttctgttccattgatcagcttgtctgtcttgatgccagtacagcactcccctgatttttgtagctttattgtaagtacagttatcccttggtttccttggggaattggttccaggaccctcatggatataaaaatcctgggatgctcgagtccaggg

SEQ ID NO: 713 - DNA, 376 bp, Homo sapiens
  CDS 276..374
  sig_peptide 276..365: Von Heijne matrix score 3.5 seq NLLKLSSHSPTCA/CK
  misc_feature 154,217: n=a, g, c or t Oligonucleotide
tatgtacatttgtcaaaactcagaaaatgtatatataatatgtgtgcatatgattttaagtagttttacataaaaagataagcaaatattggatgctggttaacactaagcatgctgaaatatttagagggaagagtattattgtctacaatyngctttaaagacaccaaaaataaggtggrttaattwawkggsywwgggrmdwtggataaatggnkagawatgtgataaagcaagtctaatagaattttgtggcagaatctaatggcggctatatggatgttagctgtaaaattctttacaatgtgattgaaaaattttgcaataatctgttgaagctttcttcccattcccctacttgtgcttgcaaactaaa

SEQ ID NO: 714 - DNA, 304 bp, Homo sapiens
  CDS 216..302
  sig_peptide 216..275: Von Heijne matrix score 3.5 seq SHLSGSSLQLCVA/QF
gtatgtgtgatttgattttatttgccctttgaactatgacccaatactccccaaacctgttattcagtttttgcccagagttattatatctggggaataaacagaggacacacacccagaggctgccagtagcaaaaatcactgtaattcaaaaagcatgacactacggtagtgaaattatcacacttttctttgcatagagcagtttacttgtgatgattttcaaagatgtgttctcccacttgtcaggttcatctcttcaactgtgtgtcgcacaatttctcgawctcagtgctgttgacat

SEQ ID NO: 715 - DNA, 242 bp, Homo sapiens
  CDS 91..240
  sig_peptide 91..222: Von Heijne matrix score 3.5 seq SFSFLFFFFLSFF/FF
gtttgtgattaagtgatttcctctagtggtatgctttgactcctctttagcttttgtgtaaatactataggtttttgctttgtggttaacatgaagcttacaaaaaatatcttatwagtaataataggctgttttaagctgatagcctacaaaaactctgtactgtacttttactctaacttctcattttcttttcttttcttttttttcctttctttcttttttttctttttttttttttt

SEQ ID NO: 716 - DNA, 375 bp, Homo sapiens
  CDS 100..375
  sig_peptide 100..360: Von Heijne matrix score 3.5 seq VAGXMLAPGGTLA/DD
ctggcgtyagttccggtcgcagaggagacaccgccgcagttgccggtacatcggggatttctggctctttcctcttcgccttaaattcgggtgtcttttatgaataatcaaaagcagcawragccaacgctatcaggccagcgttttaaaactagaaaaagagatgaaaaagagaggtttgaccctactcagtttcaagactgtattattcaaggcttaactgaaaccggtactgatttggaagcagtagctaagtttcttgatgcttctggagcaaaacttgattaccgtcgatatgcagaaacactctttgacattctggtggctggtkgaatgctggccccaggtggtacactggcagatgacatgatgcvg

SEQ ID NO: 717 - DNA, 429 bp, Homo sapiens
  CDS 324..428
  sig_peptide 324..374: Von Heijne matrix score 3.5 seq LEIKLPFLPFAQQ/ID
aacagtctatttctgtttgtaaatattagtatttctgtggattctgtacttgttccttgttatcctttcattctcttaggttcatttggtctgatggattcaggtaccattgaaattctgatagtttcaaaatcttttatctccaggtttgatctctcttgtgaactctggaactgtattcccaattgtcaattggacatccctacgtatgggacctcagatatttcaaacatgatgtgtccaagtctgtatcacttctggccatcatattgttcttttatttttccaaatttcacatcaccagtaacaaactagctgtgatcatggcagatagcctggaaataaaactcccctttttaccctttgcacagcaaattgacatcaaatcctgtttctactttttttttttwaacwatkgcttccctaggg

SEQ ID NO: 718 - DNA, 350 bp, Homo sapiens
  CDS 4..348
  sig_peptide 4..108: Von Heijne matrix score 3.5 seq ATAAATAASATTG/AS
  misc_feature 155: n=a, g, c or t Oligonucleotide
tgaatggacagaaaatggacctggaagagagggcaaaggtcacatctggagtcaggccaggctgccccggccactgcagcagctacggcagcatctgccacaacgggggcaagtgtgtggagaagcacaatgggcwacctgtgtgattgcaccanbdcaccttatgaagggcccttttgcaaaaaagaggtttctgctgtttttgaggctggcacgtcggttacttacatgtttcaagaaccctatcctgtgaccaagaatataagcctctcatcctcagctatttacacagattcagctccatccaaggaaaacattgcacttagctttgtgacaacccaagcaccggg

SEQ ID NO: 719 - DNA, 305 bp, Homo sapiens
  CDS 84..305
  sig_peptide 84..212: Von Heijne matrix score 3.5 seq VLSIKHLPPQLRA/FQ
gttttttccttttcatttcagcctgactgccggaatcagagccgcgggtgagatccccagccctgtgagcctgtaggagtagaatggctccccaaatgtatgagttccatctgccattatccccagaggagttgttgaaaagtggaggggtgaatcagtatgttgtgcaagaggtactgtccatcaaacatcttccaccacagcttagagcttttcaggctgcctttcgagctcaggggcccctggctatgctgcagcactttgatactatctacagcattttgcatcactttcgaagtatagat

SEQ ID NO: 720 - DNA, 257 bp, Homo sapiens
  CDS 6..257
  sig_peptide 6..50: Von Heijne matrix score 3.5 seq AVQVVGSWPSVQP/RE
aaaagatggctgctgtgcaagttgtcggttcgtggccttccgtgcagccgcgggaggcaccgcgggaagcaatccctgagcgaggcaatgggtttcgcctcttgtctgccaggctctgcgccctgcgcccggatgacagcagctccgcccgmaccgagatccacctgmtcttcgatcagctcatctccgagaactacagcgagggcagtggcgtggccccggaggacgtwagtgctcttcttgtccaggcttgcggg

SEQ ID NO: 721 - DNA, 360 bp, Homo sapiens
  CDS 217..360
  sig_peptide 217..306: Von Heijne matrix score 3.5 seq FLFFLQFSFPLYY/LF
  misc_feature 316,319: n=a, g, c or t Oligonucleotide
ggcatgtttatatactcattccctggtgattgtattttgcatacttgatttttacctaagcatttatcttttttcctttattttctgttgctttgtctttttgtaatgcctcctggggcaatttctttgatttttatcttgcagttcttctattgagttttgcatgttggctatcatgttttaaattttcatttttcatagtattctgtcctatggatgtttcatggctgtcatattttatcttttctgaggatatcaactagaggttttcttttttttcttcaattttcctttcctctgtattatctctttcggnggnttttccctcagtctttcatgttggaggcatttgtcagatgt

SEQ ID NO: 722 - DNA, 191 bp, Homo sapiens
  CDS 64..189
  sig_peptide 64..141: Von Heijne matrix score 3.5 seq LVLYAPWVPPLLL/AF
ttctcctcttgtgaaggcagctcctcagatccagggagtatctgcacggacctcatttatgttatgtatagacattccaaacagcgtaataatgtcccatgccttgtactctacgccccttgggtccctcccctcctcctagctttctggggctggtggctcctggagcagggtctttttttttttttttt

SEQ ID NO: 723 - DNA, 473 bp, Homo sapiens
  CDS 63..473
  sig_peptide 63..212: Von Heijne matrix score 3.5 seq ITYGVFLCIDCSG/SH
tttttttttcgtcgactcttaccggttggctgggccagctgcgccgcggctcacagctgacgatgggggaccccagcaagcaggacatcttgaccatcttcaagcgcctccgctcggtgcccactaacaaggtgtgttttgattgtggtgccaaaaatcccagctgggcaagcataacctatggagtgttcctttgcattgattgctcagggtcccaccggtcacttggtgttcacttgagttttattcgatctacagagttggattccaactggtcatggtttcagttgcgatgcatgcaagtcggaggaaacgctagtgcatcttccttttttcatcaacatgggtgttccaccaatgacaccaatgccaagtacaacagtcgtgctgctcagctctatagggagaaaatcaaatcgctcgcctctcaagcaacacggaagcatggcactgatctgtggcttgatagttgt

SEQ ID NO: 724 - DNA, 139 bp, Homo sapiens
  CDS 60..137
  sig_peptide 60..125: Von Heijne matrix score 3.5 seq LLLHLVFHQRTLI/SL
tttagcattcaagccgtgattagtgctttctcttctccccagcctgcctttcagaacagatgcctctccctcccaatcagtcccctctactgctgcacctggtgtttcatcaaaggaccctgatttccctcccgccgcc

SEQ ID NO: 725 - DNA, 187 bp, Homo sapiens
  CDS 125..187
  sig_peptide 125..163: Von Heijne matrix score 3.5 seq MFLTFFFCTQVHG/PS
tcttcgggaactctcactctctcataaactactttattaccatcccaccatatcctgtcctctttttttggcctacttagatctgttttcctttcttgccttaaatgggaattgctagaggmatatgtttctaactttttttttctgcacacaagttcatggtccttctatacttgatagcccagct

SEQ ID NO: 726 - DNA, 207 bp, Homo sapiens
  CDS 39..206
  sig_peptide 39..80: Von Heijne matrix score 3.5 seq VTLWIFQFFLCLT/CK
  misc_feature 154: n=a, g, c or t Oligonucleotide
aatataaataccaaatacataaatagttttggtgttagatggtcactttatggatttttcaatttttcttgtgtttgacttgtaaagcttataatttaagaaactgtaatgatgggaaggghwgagsmtcagwggtgcttggattggaacaamnrctacctgaatctgctggtatggtacawtttttaggtttgaaacacaggtggg

SEQ ID NO: 727 - DNA, 164 bp, Homo sapiens
  CDS 54..164
  sig_peptide 54..95: Von Heijne matrix score 3.5 seq VLWAGPXVPLLCA/AX
agacaatggggmmaatgtcacacatcacagaccaagaggcctaggaggavaagatggttttgtgggctgggcccakggtccccctgctgtgtgcagcctasggacttggtgccctgcatcccagatgctctagtcaaggcttgaggcttgcrscttctgaagcc

SEQ ID NO: 728 - DNA, 321 bp, Homo sapiens
  CDS 139..321
  sig_peptide 139..261: Von Heijne matrix score 3.5 seq FNIGLLWVPXXXG/AV
catggaaatcactccaatcagaccggcccgaggatacgctttcttgtgatccgcagcagcgccattagcatcataaaccaggtgattggctggatctactttgtggcctggtccatctccttctaccctcaggtgmtcatgaattggaggcggaaaagtgtcattggtctgagcttcgacttcgtggctctgaacctgacgggcttcgtggcctacagtgtattcaacatcggcctcctctgggtgccctwcwtcdaaggagcagtttctcctcaaataccccaacggagtgaaccccgtgaacagcaacgacgtcttctt

SEQ ID NO: 729 - DNA, 472 bp, Homo sapiens
  CDS 25..471
gacttccctctagaatcctccaacatggagcctcttgcagcttacccgctaaaatgttccgggcccagagcaaaggtatttgcagttttgctgtctatagttctatgcacagtaacgctatttcttctacaactaaaawtcctcaaacctaaaatcaacagcttttatgcctttgaagtgaaggatgcaaaaggaagaactgtttctctggaaaagtataaaggcaaagtttcactagttgtaaacgtggccagtgactgccaactcacagacagaaattacttagggctgaaggaactgcacaaagagtttggaccatcccacttcagcgtgttggcttttccctgcaatcagtttggagaatcggagccccgcccaagcaaggaagtagaatcttttgcaagaaaaaactacggagtaactttccccatcttccacaagattaagattctaggatctgaaggagaactgc

SEQ ID NO: 730 - DNA, 465 bp, Homo sapiens
  CDS 70..465
actcggggagactccaaacagtgagcctagagctggagactagcgttaaccggcggggcggccggttttatgaatgaagctatggctacagattccccaagaagacccagtcgttgtactggtggagttgtggttcgcccccaggctgtcacagagcagtcctacatggaaagtgttgtgacttttctgcaggatgttgtgccacaggcttacagtggaacacctctaacagaagaaaaggagaaaatagtctgggtcagatttgaaaatgcagatttaaatgatacatcaagaaatctggaatttcatgaaatacatagtactgggagtgaaccgcctttgttgattatgattggctacagtgatggaatgcaggtctggagcatccctatcaktggcgaasacaagagctcttctctgttcgacatggcccaattcgagcggctagaatcttgcctgctccac

SEQ ID NO: 731 - DNA, 345 bp, Homo sapiens
  CDS 207..344
agacgcgacggtgctgggatcccgggagggakcggaacggacctgggcttggtcgcctccaagccggcgggaccgagtgctttaggccgctygaaagaaagttgctccgacccgggaaaaggagaagatgaaggaagccaaggatgcccgctataccaatgggcacctcttcaccaccatttcagtttcaggcatgaccatgtgctatgcctgtaacaagagcatcacagccaaggaagccctcatctgcccaacaacagaaagcggccctgctgaakaacaacaccgccttgcagtccgtttctcttcgaagtaagacaaccatccgggagcggccaagctcgg

SEQ ID NO: 732 - DNA, 398 bp, Homo sapiens
  CDS 274..396
agcaaccaagtcgcacctggagctgtcctagcgcctagttctctcccggccgcagagctggccgcccagggggagtcgcagagtttggaagatctctctaacacctctcggccaacttcagaagtgtataagatcagctttatctttccaaatggagacaagtatgatggtgactgtacaagaacatcttctggaatctacgagagaaatggaataggtattcataccactcctaatgggattgtctacacaggaagctggaaagatgacaagatgaatggttttggaagacttgagcatttttcaggagcagtatatgaaggacaatttaaggataatatgtttcatggactggggacttacacattcccaaatggggcaaagtatactggaatttc

SEQ ID NO: 733 - DNA, 443 bp, Homo sapiens
  CDS 49..441
ggaagttcttgggagcgccagttccgtctgtgtgttcgagtggacaaaatggcgaagatcgccaagactcacgaagatattgaagcacagattcgagaaattcaaggcaagaaggcagctcttgatgaagctcaaggagtgggcctcgattctacaggttattatgaccaggaaatttatggtggaagtgacagcagatttgctggatacgtgacatcaattgctgcaactgaacttgaagatgatgacgatgactattcatcatctacgagtttgcttggtcagaagaagccaggatatcatgcccctgtggcattgcttaatgatataccacagtcaacagaacagtatgatccatttgctgagcacagacctccaaagattgcagaccgggaagatgaatacaaaaagcataggcggaccatgataatttcccagagcgt

SEQ ID NO: 734 - DNA, 373 bp, Homo sapiens
  CDS 128..373
gagaagccgcagtctcgagagcgtcaacgaggtgtttcggtagtctctggccatcctttctgcgcacccggtgtcgctgggctgcaccccgggcggggacgtccgccgggcacgggagggggccaagatgccgatcaataaatcagagaagccagaaagctgcgataatgtgaaggttgttgttaggtgccggcccctcaatgagagagagaaatcaatgtgctacaaacaggctgtcagtgtggatgagatgaggggaactatcactgtacataagactgattcttccaatgaacctccaaagacatttacttttgatactgtttttggaccagagagtaaacaacttgatgtttataacttaactgcaaga

SEQ ID NO: 735 - DNA, 322 bp, Homo sapiens
  CDS 202..321
agagcggtggcggcggctgcgcsggctgtgagtctctcgccgccggaggaagatgaggctgaagattggattcatcttacgcagtttgctggtggtgggaagcttcctggggctagtggtcctctggtcttccctgaccccgcggccggacgacccaagcccgctgagcaggatgagggaagacagagatgtcatgaccccatgcccaaccgaggcggcaatggactagctcctggggaggacagattcaaacctgtggtaccatggcctcatgttgaaggagtagaagtggacttagagtctattagaagaataaacaagg

SEQ ID NO: 736 - DNA, 181 bp, Homo sapiens
  CDS 75..179
acttcgccattttcctccggaagtgcggatcccagcggcggtcgtgtagctgagcagscctggggcttggttctatgtccctgtggctatgtttccagtgtcctctgggtgtttccaagagcaacaagaaacgaataaatctctgtaatggtttctggaatgaaaaaataaaaaacaggag

SEQ ID NO: 737 - DNA, 160 bp, Homo sapiens
  CDS 18..158
tgaatgactggctatttatgggcacccatgtttttgctataaataaacgtacatatgtaatttcaagagaccgagaattatcaactgcaaagcccawrtgtagcagtctactcacggcccctgtactttgctactggagggcctgtcctctgcaaaccca

SEQ ID NO: 738 - DNA, 234 bp, Homo sapiens
  CDS 66..233
gttgttagttttctttttagctgaattacccactcacatccttattattttatgccactgatttcatgttttgttttctattttcatggtggcttagaggaggtcttcatgtattattaaacacatgcttatatgtaccttatgggtatttgtcacttatttgtttactttgtttatggtatcttaatctatacaaattctcaattttcttttcttttctttcttttttttttt

SEQ ID NO: 739 - DNA, 589 bp, Homo sapiens
  CDS 424..588
atcaaaagaactcttatatacaggagcccaggcaccatactgtcttttcgaggtaggagtcgactcctgtgaggtatggtgctgggtgcagatgcagtgtggctctggatagcaccttatggacagttgtgtccccaaggaaggatgagaatagctactgaagtcctaaagagcaagcctaactcaagccattggcacacaggcattagacagaaagctggaagttgaaatggtggagtccaacttgcctggaccagcttaatggttctgctcctggtaacgtttttatccatggatgacttgcttgggtatggagagtcggcttgactacactgtgtggagcaagttttaaagaagcaaaggactcagaattcatgattgaagaaatgcaggcagacctgttatcctaaactagggtttttaatgaccacaacaagcaagcatgcagcttactgcttgaaagggtcttgcctcamccaagctagagtgcagtggcctttgaagcwtactacagcctcaaacttctgggctcaagtgatcctcagcctcccagtggtctttgtagactgcctgatggagtmtcatggca

SEQ ID NO: 740 - DNA, 388 bp, Homo sapiens
  CDS 26..388
aaaaaacgctgttggaaatctcgcgatggagggaggaggaggtatacccctagaaacacttaaagaagaaagtcagtcaagacatgttctacctgcaagttttgaagtcaacagtttgcagaaaagcaactgggggttcttacttactgggcttgtgggtggcaccctggtggctgtgtacgctgtagccacgccgtttgtaacgccagcccttcgaaaagtctgtttgccatttgtacctgcaactatgaagcagattgaaaatgttgtgaaaatgttgcgatgccgaagaggatcccttgtggacatcggtagtggggacggacgcattgtcatagcggctgcgaagaaagggttcamagcagttggttatgaattaaacccatgg

SEQ ID NO: 741 - DNA, 478 bp, Homo sapiens
  CDS 15..476
agtgcgcctctaagatggcgacgcctttggcggtaaattcggctgctagtctatggggtccttacaaagacatttggcataaagtgggaaatgctctttggagaagacaacctgaagctgttcamcttcttgataagattttgaagaaacacaaacctgacttcatctcattgttcaaaaatccgccaaaaaatgttcaacagcatgagaaggttcagaaagccagtacagagggagtcgccattcagggtcaacagggaactcgacttcttcctgaacagctcattaaagaagcctttattctcagtgacctttttgatattggagaattggcagctgttgagcttcttcttgctggagagcatcaacagccacattttcctggccttaccagaggattagtagctgttcttctgtactgggatggaaagcgatgcattgcgaattccttgaaagccttgatacagtctagacgggg

SEQ ID NO: 742 - DNA, 752 bp, Homo sapiens
  CDS 377..751
atttcctgccgtaagtatacagtgcctccgggtcgcggtcattttgagcccctgtctggatgacttcttgcggctgttctacccctccccctccccgcgtcggcctgmctgctgtcgtcgggaggtgggtgaggtgacgcaaacagccccgttgttgccctccgcgtatcccctcaccacctttgcggccatccacgactttcgcaccttccgccattttcctgcctgtgagggtggacagatcgcgctcgggtctcggcctcctgagtgccggtgactgcgggaggcgacggagtgcttctgggggtgtgagctggggaagttcgtggtcacggatgcgtgtggggttgctgctcagtctgtaacggcaggaaagatgaatgggagggctgattttcgagagccgaatgcagaggttccaagaccaattccccacatagggcctgattacattccaacagaggaagaaaggagagtcttcgcagaatgcaatgatgaaagcttctggttcagatctgtgcctttggctgcaacaagtatgttgattactcaaggattaattagtaaaggaatactttcaagtcatcccaaatatggttccatccctaaacttatacttgcttgtatcatgggatactttgctggaaaactttcttatgtgaaaacttgccaagagaaattcaagaaacttgaaaattccccccttggagaagctttacgatcaggacaagcacgacgatcttcaccacctg

SEQ ID NO: 743 - DNA, 459 bp, Homo sapiens
  CDS 353..457
  misc_feature 438: n=a, g, c or t Oligonucleotide
cctatcactggagaatgggtttggtgctttgagctgtgtttctacataaaaaagaaggaatcaaagtgatgctggtgtgacaatataacatttgaagctgctccaaacaactttgactgtaagaaaatggccaagagaatacaagaggctctaaccaaggactctgacttcactaagccactgaaacattcctggcactacctacctcctgccttttcgttatgggaggaaaccctattggttaggtcactggtttaaaacacgtcctttaaattgcagaggaagaaaaggcttggaggtgataaaggaatayagttcattcccttsmttatggtgatggtttcataggcatatgcatatgtccaaactcatcaacttgtatacatcaratatgtgcaatttactgtmtatccacctymtctymataagctgtttaantaataataarrtaacattacg

SEQ ID NO: 744 - DNA, 411 bp, Homo sapiens
  CDS 79..411
atggggacggggctgttcccggggaggctgtgatgggttgacaggtgcgtgacagtgggagctgctctcggcacaagcatgtacggcaaaggcaagagtaacagcagcgccgtcccgtccgacagccaggcccgggagaagttagcactctacgtatatgaatatctgctccatgtaggagctcagaaatcagctcaaacatttttatcagagataagatgggaaaaaaacatcacattgggggaaccaccaggattcttacattcttggtggtgtgtattttgggatctctactgtgcagctccagagagacgtgaaacatgtgaacactcaagtgaagcaaaagccttccatgattacagtgctgcagcagctcccagtccagtgctaggaaacattcccccaggagat

SEQ ID NO: 745 - DNA, 404 bp, Homo sapiens
  CDS 83..403
ctctggggcggasggccaccatcttggaacgggaggcggasagagtcgactgggagcgaccgagcgggccgccgccgccgccatgaaccccgaatatgactacctgtttaagctgcttttgattggcgactcaggcgtgggcaagtcatgcctgctcctgcggtttgctgatgacacgtacacagagagctacatcagcaccatcggggtggacttcaagatccgaaccatcgagctggatggcaaaactatcaaacttcagatctgggacacagcgggccaggaacggttccggaccatcacttccagctactaccggggggctcatggcatcatcgtggtgtatgacgtcactgaccaggaatcctacgccarygtgaagcagtggctgcaggagattgacc

SEQ ID NO: 746 - DNA, 429 bp, Homo sapiens
  CDS 336..428
  misc_feature 393: n=a, g, c or t Oligonucleotide
ggcttcttccagtcacctcggcccggatcgggaagtgtcaagcgggcgctcccccatctccgccgctattaccactgaacccggaccccctacccaggtccagggccagccgccatgacgaacgtgtactccttggatgggattctggtgtttggtttgctctttgtttgcacctgtgcctacttcaagaaagtacctcgtctcaaaacctggctgctatcagagaagaagggtgtttggggtgtgttttacaaagccgstgtgattggaaccaggctgcatgctgctgtggcaattgcttgtgttgtaatgggcttttacgtcctgtttataaaatgaattccaaagcasccaagtcatcaactgccaaccaaggggacggggatgaagaanctgttgggmgamctgaasccagtgtaggagagttca

SEQ ID NO: 747 - DNA, 179 bp, Homo sapiens
  CDS 35..178
  misc_feature 140: n=a, g, c or t Oligonucleotide
gaaatatacaataccttatgttgtatattacattatgttgtatagtacgttgaaacatacactacaatacgttatcattaattgtggtcaccatgctgtgcaaaagatctctaaaacgtattcctcctgtctgactgaanytttgtatcctttgcctaatatctccccaatccctccac

SEQ ID NO: 748 - DNA, 383 bp, Homo sapiens
  CDS 101..382
ctatattagttgtggagaagaacacacagcagttctcacaaagagwggaggtgtgtttacctttggcgctggttcctgtgggcaacttggacacgactccatgaatgatgaggttaaccctagaagagttctagagctgatgggtagtgaagtaactcaaattgcttgtggcagacaacataccctagsmttcgtgccttcttctggactcatctatgcatttggttgtggagcaagaggtcaattaggaactgggcacacttgtaatgttaagtgcccatctcctgtcaagggttactgggctgcccacagtggccagctttcagcccgagctgatcgctttaaatatcatatcgttaagcagatcttctctggaggagacc

SEQ ID NO: 749 - DNA, 446 bp, Homo sapiens
  CDS 381..446
aacaatcacagctccgggcattgggggaaccssagccggctgcgccgggggaatccgtgcgggcgccttccgtcccggtcccatcctcgccgcgctccagcacctctgaagttttgcagcgcccagaaaggaggcgaggaaggcagggagtgtgtgagaggagggagcaaaaagctcaccctaaaacatttatttcaaggagaaaagaaaaagggggggcgcaaaaatggctggggcaattatagaaaacatgagcaccaagaagctgtgcattgttggtgggattctgctcgtgttccaaatcatcgcctttctggtgggaggcttgattgctccagggsccacaacggcagtgtcctacatgtcggtgaaatgtgtggatgcccgtaagaaccatcacaagacaaaatggttcggtgccttggggacccaatcattgtgacaag

SEQ ID NO: 750 - DNA, 410 bp, Homo sapiens
  CDS 129..410
ttttctcctcctcctcagggctccagtcaggccgatccgctccgctcacggaaggaaaacagaaataacttgctggcttgtctggagtcacatggtgacaatttacagaaagtcatctctgcagcttgatgggcgacaacccttttcaaccaaaaagtaattcaaaaatggcagaactgtttatggaatgtgaagaagaggagctggaaccatggcagaagaaagtaaaagaagttgaggatgacgatgatgatgagccaatctttgttggcgagatatcaagttcaaaaccagcaatttcaaatattttgaacagagttaaccccagctcatattcaaggggactaaagaatggtgcactcagtcgaggtattactgctgcattcaagcctacaagtcaacactacacg

SEQ ID NO: 751 - DNA, 536 bp, Homo sapiens
  CDS 334..534
  misc_feature 148: n=a, g, c or t Oligonucleotide
cctccctcccaccggaaaactctgaggacatgaatagtcgccaggcttggcggctcttgctctcccaaggcagaggagatcgttgggtttcaaggccccgcgggcatttctcgccggccctgcggagagagttcttcactaccacaancmarggagggatatgataggcggccagtggatataactcctttagaacaaaggaaattaacttttgatacccatgcattggttcaggacttggaaactcatggatttgacaaaacacaagcagaaacaattgtatcagcgttaactgctttatcaaatgtcagcctggatactatctataaagagatggtcactcaagctcaacaggaaataacagtacaacagctaatggctcatttggatgctatcaggaaagacatggtcatcctagagaaaagtgaatttgcaaatctgagagcagagaatgagaaaatgaaaattgaattagaccaagttaagcaacaactaatgcatgaaaccagtygaatcagagcagataataaactgga

SEQ ID NO: 752 - DNA, 139 bp, Homo sapiens
  CDS 25..138
cttggatctttggtgttaccttaaatgaaatttggaaatgttaggatgtyatctattcaaatatttattgtgtccatctggagcttcttccttttctatggcaagtatacatatattagactgatcttgtcccaaggcc

SEQ ID NO: 753 - DNA, 193 bp, Homo sapiens
  CDS 87..191
tattacagagtttgcagactgaaagagagtctagctaaggcttgctcctcatacccaggatttgatctaatccaacaagcctttgtatgacctttgacctcagtgtgttcagtactttgtcagatcacttttactcatcatcattgtccaatactgcaaggaatctgtatatttgtttatttcatatcacaca

SEQ ID NO: 754 - DNA, 395 bp, Homo sapiens
  CDS 310..393
cggcctcgcacttccggtggggagattccggcctggagctcccagggccgagcagaccttgggacctgtgagcgctgcatccaattaaccatgggaagggtcagcaccagccaccagccccttaggtgaggactctgcctggggctctgctgatggttccgaatcatggagctgcagagagctcctccagcctggagacgttcttggtgaaagctgtggtctaactccaccggctcttcctgcacattgtattcaagaggggtgcctgcccccgctgactcaggagctccggtgctgcagccgccacgaatggggaggtgggccctcgatgtggcctttttgtggaaggcggtgttgaccctggggctggtgcttctctactactgcttctccat

SEQ ID NO: 755 - DNA, 460 bp, Homo sapiens
  CDS 76..459
agaaggctgtgcgtgctcctcgctttctccgcggtcttccgagcggtcgcgtgaactgcttcctgcaggctggccatggcgcttcacgttcccaaggctccgggctttgcccagatgctcaaggagggagcgaaacacttttcaggattagaagaggctgtgtatagaaacatacaagcttgcaaggagcttgcccaaaccactcgtacagcatatggaccaaatggaatgaacaaaatggttatcaaccacttggagaagttgtttgtgacaaacgatgcagcaactattttaagagaactagaagtacagcatcctgctgcaaaaatgattgtaatggcttctcatatgcaagagcaagaagttggagatggcacaaactttgttctggtatttgctggagctctcctggaattagctgaagaacttctgaggattggcctgtcagtttcagaggtca

SEQ ID NO: 756 - DNA, 142 bp, Homo sapiens
  CDS 42..140
aagcctgacttcagcgctcccactctcggccgacacccctcatggccaaccgttacaccatggatctgactgccatctacgagagcctcctgtcgctgagccctgacgtsaccctcacccacttcgcccactgcaacctcca

SEQ ID NO: 757 - DNA, 362 bp, Homo sapiens
  CDS 158..361
atcttgtaggcggggacacgccgaggtaacttccagggtgcgccttcgttgtcttctccaagctgtagttctacgtcccgacctccctatcataccacactcttcagcgaccacgcaggcactttcccggtccccagtataccataattgaagaaaaatgatggaagagagtggaatagagacaacaccacctgggactcctccaccaaatcctgcagggctggctgctactgctatgtcttctacccctgttccattagcggcaaccagttctttttcttctccaaatgtatcctccatggagtccttcccaccactcgcatactctactcctcagccgccccttcctcctgtgaggcctt

SEQ ID NO: 758 - DNA, 368 bp, Homo sapiens
  CDS 219..368
  misc_feature 317: n=a, g, c or t Oligonucleotide
gaagaaggctcttacagcatggccgccggtactgcagctgccttagcgtttttgagtcaggagagccgaacgcgggccgggggtgtcgggggcctacgggtcccggccccggtcactatggacagttttttcttcggctgtgagctctccggccacacccgctccttcacctttaaggtagaggaagaggatgatgcggasacgtgctggcactaaccatgctctgcctcaccgagggagccaaagacgagtgtaatgtggtagaagttgtggcccggaaccatgaccatcaggagatcgcagtccctgtggccaanctcaagctgtcctgccaacccatgctcagtctggatgacttccagctccaa

SEQ ID NO: 759 - DNA, 452 bp, Homo sapiens
  CDS 36..452
agctcgctgcgcaggcgcagtgagttcgacacaccatgccgactgtcagcgtgaagcgtgatctgctcttccaagccctgggccgcacctacactgacgaagaatttgatgaactatgttttgaatttggtctggagcttgatgaaattacatctgagaaggaaataataagtaaagaacaaggtaatgtaaaggcagcaggagcctctgatgttgttctttacaaaattgacgtccctgccaatagatatgatctcctgtgtctggaaggattggttcgaggacttcaggtcttcaaagaaaggataaaggctccagtgtataaacgggtaatgcctgatggaaaaatccagaaattgattatcacagaagagacagctaagatacgtccttttgcggtagcagcagttctccgtaatataaagtttactaaagatcgatatgacagcttc

SEQ ID NO: 760 - DNA, 295 bp, Homo sapiens
  CDS 83..295
aagctgcggttcgaaaatsstgacagcacagggcttcctgggctctgcagagcaaactggaaagagctgggatccaggcactatgttctctgaagaactgtggctggaaaatgagaaaaagtgtgctgtggttcggaagtctaagcagggcaggaaacgccaagaactgctggccgtagccttcggggtgaaggtccacacgttccgaggcccacactggtgtgaatattgtgccaatttcatgtgggggctcatcgcccaaggggtccggtgctcagactgtggattgaacgta

SEQ ID NO: 761 - DNA, 212 bp, Homo sapiens
  CDS 124..210
ttggccattttattcctttggctttgatttgtgaactatatccaagactcattggagtaatagttaactgattgcagtggatttcgaggtgtggcaactagtggcaatgctcatgcgacagtgatggtggttttcatgacatatgtaactttacccttttttttttctttcatctcttcccttctttcatttttttttctttttctactctc

SEQ ID NO: 762 - DNA, 623 bp, Homo sapiens
  CDS 474..623
agtggggagtttaggcaagtgcctgatttgggtaatcgaaagcacccagtgattgtatttgatgacttttaagctttcatatgccgttatttaatacctgtcacttccaaatgagagatgtaagggcaacggccgttagcgttctgwtttggatcaggctctggagtggacgcccctagcttaggggtccttctaggcagccagaaacctgcggaaaatggtagcgatggcggctgggccgagtgggtgtctggtgccggcgtttgggctacggttgttgttggcgactgtgcttcaagcggtgtctgcttttggggcagagttttcatcggaggcatgcagagagttrggcttttctagcaacttgctttgcagctcttgtgatcttctcggacagttcaacctgcttcagctggatcctgattgcagaggatgstgtcaggaggaagcacaatttgaaaccaaaaagctgtatgcaggagctattcttgaagtttgtggatgaaaattgggaaggttccctcaagtccaagtatgtccgtggttcagaccctgtattaaagcttttggacgacaatgggaacattgctgaagaactgagcattctcaaatggacacagaca

SEQ ID NO: 763 - DNA, 261 bp, Homo sapiens
  CDS 58..261
gacatccacggggcgcgagtgacacgcgggagggagagcagtgttctgctggagccgatgccaaaaaccatgcatttcttattcagattcattgttttcttttatctgtggggcctttttactgctcagagacaaaagaaagaggagagcaccgaagaagtgaaaatagaagttttgcatcgtccagaaaactgctctaagacaagcaagaagggagacctactaaatgcccattatgacggctacctggctaaagacggc

SEQ ID NO: 764 - DNA, 160 bp, Homo sapiens
  CDS 4..159
agtatgcttgaggaattgaaagctggccaggagttggaggaacagaccattagccacggctttgcacgtggtgtgaggaggggtgtggctattgtgggcaagggtctggaatggcatgggtgttggtggatgtgccacggatacaggattctagccggga

SEQ ID NO: 765 - DNA, 516 bp, Homo sapiens
  CDS 404..514
aagaaagagagaggcaagcgaaattcctgaatggatagacagatgctacgtcatcggagctgcatcctccactccacaagaggctaggagctggggggagagaggcagtccagccgcagggccacccgaacagtctctcctcctcacagaagcctggagctgggcatccaagaagaagcagcctcatttgttttctggtgtcatcgtaggtggccacctatggcttttgggcttctcacctggggcgggtgggttctgcaccaccctcccaccctccttcctccgtgtggacgatagagccacatccagcaccacggacagctcccgggcgaccaaaaagaagaatgtacttcatctggttgggctggattccctctgataagccttcccagttgactgaaagatgaggctaggctctagcaagttgaagtcaaaccagctccttcaagaagctttgagcagaatgaagtggggaggacccagcttccagcccaggaagcccactgtacctggagc

SEQ ID NO: 766 - DNA, 626 bp, Homo sapiens
  CDS 68..238
  sig_peptide 68..106: Von Heijne matrix score 15 seq MLLLLLLLPLALG/DK
  misc_feature 529: n=a, g, c or t Oligonucleotide
agtttctgagagaagaaccctgaggaacagacgttccctggcggccctggcgccttcaaacccagacatgctgctgctgctgctgctgctgccccttgctctgggggacaaaggggatggagggagacagacaatatggggatggttacttgctgcaagtgcaggagctggtgacggtgcaggagggcctgtgtgtccatgtgccctgctccttctcctacccccaggatggctggactgactctgacccagttcatggctactggttccgggcagggaatgatataagctggaaggctccagtggccacaaacaacccagcttgggcagtgcaggaggaaactcgggaccgattccamctycyttggggacccacagaccaaaaattgcactctgagcatcagagatgccagaatgagtgatgcggggagatacttctttcgtatggagaaaggaaatataaaatggaattataaatatgaccagctctctgtgaacgtgayagccttgacccacaggcccaacatsnktatccccggtaccctggagtctggctgcttccagaatctgacctgctctgtgccctgggcctgtgagcaggggacgccccctatgatctcctggat

SEQ ID NO: 767 - DNA, 473 bp, Homo sapiens
  CDS 60..344
  sig_peptide 60..113: Von Heijne matrix score 10.3000001907349 seq VLMLAALLLHCYA/DS
acagcaacttccttgatccctgccacgcacgactgaacacagacagcagccgcctcgccatgaagctgctgatggtcctcatgctggcggccctcctcctgcactgctatgcagattctggctgcaaactcctggaggacatggttgaaaagaccatcaattccgacatatctatacctgaatacaaagagcttcttcaagagttcatagacagtgatgccgctgcagaggctatggggaaattcaagcagtgtttcctcaaccagtcacatagaactctgaaaaactttggactgatgatgcatacagtgtacgacagcatttggtgtaatatgaagagtaattaactttacccaaggcgtttggctcagagggctacagactatggccagaactcatctgttgattgctagaaaccacttttctttcttgtgttgtctktttatgwggaaamtgctagacaactgttgaaa

SEQ ID NO: 768 - DNA, 673 bp, Homo sapiens
  CDS 218..502
  sig_peptide 218..310: Von Heijne matrix score 9.19999980926514 seq RLLLATVLQAVSA/FG
agtggggagtttaggcaagtgcctgatttgggtaatcgaaagcacccagtgattgtatttgatgacttttaagctttcatatgccgttatttaatacctgtcacttccaaatgagagatgtaagggcaacggccgttagcgttctgwtttggatcaggctctggagtggacgcccctagcttaggggtccttctaggcagccagaaacctgcggaaaatggtagcgatggcggctgggccgagtgggtgtctggtgccggcgtttgggctacggttgttgttggcgactgtgcttcaagcggtgtctgcttttggggcagagttttcatcggaggcatgcagagagttaggcttttctagcaacttgctttgcagctcttgtgatcttctcggacagttcaacctgcttcagctggatcctgattgcagaggatgctgtcaggaggaagcacaatttgaaaccaaaaagctgtatgcaggagctattcttgaagtttgtggatgaaaattgggaaggttccctcaagtccaagcttttgttaggagtgataaacccaaactgttcagaggactgcaaatcaagtatgtccgtggttcagaccctgtattaaagcttttggacgacaatgggaacattgctgaagaactgagcattctcaaatggacacagaca

SEQ ID NO: 769 - DNA, 539 bp, Homo sapiens
  CDS 190..492
  sig_peptide 190..285: Von Heijne matrix score 8.80000019073486 seq VPMLLLIVGGSFG/LR
  misc_feature 500..501: n=a, g, c or t Oligonucleotide
acaagtatgttacgatggctcgattgcttttgcctagcggaaaccattcactaaggaccgagcaccaaataaccaaggaaaaggaagtgagttaaggacgtactcgtcttggtgagagcgtgagctgctgagatttgggagtctgcgctaggcccgcttggagttctgagccgatggaagagttcactcatgtttgcacccgcggtgatgcgtgcttttcgcaagaacaagactctcggctatggagtccccatgttgttgctgattgttggaggttcttttggtcttcgtgagttttctcaaatccgatatgatgctgtgaagagtaaaatggatcctgagcttgaaaaaaaactgaaagagaataaaatatctttagagtcggaatatgagaaaatcaaagactccaagtttgatgactggaagaatattcgaggacccaggccttgggaagatcctgacctcctccaaggaaagaaatccagaaagccttaagacanngacaacttgactctgctgattcttttttcctttttttt

SEQ ID NO: 770 - DNA, 479 bp, Homo sapiens
  CDS 124..468
  sig_peptide 124..276: Von Heijne matrix score 8.10000038146973 seq VCLCGTFCFPCLG/CQ
aagttacctctcccctttcacgtarttttcatttgtggtgagattctctcccaggccacaagacatttcctgctcggaaccttgtttactaatttccactgcttttaaggccctgcactgaaaatgcaagctcaggcgccggtggtcgttgtgacccaacctggagtcggtcccggtccggccccccagaactccaactggcagacaggcatgtgtgactgtttcagcgactgcggagtctgtctctgtggcacattttgtttcccgtgccttgggtgtcaagttgcagctgatatgaatgaatgctgtctgtgtggaacaagcgtcgcaatgaggactctctacaggacccgatatggcatccctggatctatttgtgatgactatatggcaactctttgctgtcctcattgtactctttgccaaatcaagagagatatcaacagaaggagagccatgcgtactttctaaaaactgat

SEQ ID NO: 771 - DNA, 492 bp, Homo sapiens
  CDS 25..402
  sig_peptide 25..96: Von Heijne matrix score 7 seq LLCCFRALSGSLS/MR
  misc_feature 371: n=a, g, c or t Oligonucleotide
agsctggccctccctctttccaaaatggacaagtccctcttgctggaactccccatcctgctctgctgctttagggcattatctggatcactttcaatgagaaatgatgcagtcaatgaaatagttgctgtgaaaaacaattttcctgtgatagaaattgttcggtgtaggatgtgccacctccagttcccaggagaaaagtgctccagaggaagaggaatatgcacagcaacaacagaagaggcctgcatggttggaaggatgttcaaaagggatggtaatccctggttaaccttcatgggctgcctaaagaactgtgctgatgtgaaaggcataaggtggagtgtctatttggtgaacttcaggtgctnmaggagccatgacctgtgcaatgaagacctttagaagttaatggttcttctgtgactccaatttctgggtgaggttgttgcctcagcctcttcacaatgactttctaaaaaaatcacacac

SEQ ID NO: 772 - DNA, 396 bp, Homo sapiens
  CDS 7..312
  sig_peptide 7..54: Von Heijne matrix score 6.80000019073486 seq LWILPSLWLLLLG/GP
agcaagatggatctactgtggatcctgccctccctgtggcttctcctgcttggggggcctgcctgcctgaagacccaggaacaccccagctgcccaggacccagggaactggaagccagcaaagttgtcctcctgcccagttgtcccggagctccaggaagtcctggggagaagggagccccaggtcctcaagggccacctggaccaccaggcaagatgggccccaagggtgagccaggagatccagtgaacctgctccggtgccaggaaggccccagaaactgccgggagctgttgagcagggcgccaccttgagcggctggtamcatctgtgcctacctgagggcagggcctcccagtcttttgtgacatggacaccgaggggggcggctggct

SEQ ID NO: 773 - DNA, 417 bp, Homo sapiens
  CDS 50..229
  sig_peptide 50..106: Von Heijne matrix score 6.59999990463257 seq SAVVLPSTPQASA/NP
  misc_feature 206,354: n=a, g, c or t Oligonucleotide
acaggatcgatttacggycgcagagaaaaaccaagatttcactttcaagatggaaagtccgtcagrctcagctgtggttttacctagcactcctcaggcctctgcgaatccatcatctccctatacaaatagttcccgaaaacaacctatgagtgcaacacttagagaaagattaaggaaaacaagattttcatttaattcctctnacaatgtggtgaacgtcttaaagtagagagtgaagaaaatgatcagaccttttcagagaacccagcatcttccacagaggraaactgtttggrattcaaagaaagtttaaamcatatagrcagtgatttgaagaaaatacaaatttgnaaaatactttgaagaatctcaatgtctgtgaatctcagtcacttgattctggatcatgcagtg

SEQ ID NO: 774 - DNA, 454 bp, Homo sapiens
  CDS 153..443
  sig_peptide 153..200: Von Heijne matrix score 6.40000009536743 seq WLWPLYFLPVSGA/LR
  misc_feature 359: n=a, g, c or t Oligonucleotide
aggttgtcatttcctcatcgtcaagctttgttcctcgtgggggctagaaatctctttccagttccagattgtgaagggttcctgagtaagcagcgtgtctccatccccctctctaggggctcttggatggaccttgcactctagaagggacaatggacttctggctttggccactttacttcctgccagtatcrggggccctgaggatcctcccagaagtaaaggtagagggggagctgggcggatcagttaccatcaagtgcccacttcctgaaatgcatgtgaggatatatctgtgccgggagatggctggatctggaacatgtggtaccgtggtatccaccaccaacttcatcaangcagaatacaagggccgagttactctgagagcaatacccacgcaagaatctgttcctagtggaggtaacacagctgacagaaagtgacagcggag

SEQ ID NO: 775 - DNA, 531 bp, Homo sapiens
  CDS 8..253
  sig_peptide 8..109: Von Heijne matrix score 6.19999980926514 seq MAVLAPLIALVYS/XP
agtcgttatggtgggggaggcggggcgagacctacgacgccggcgagcagtggccgttacggccgaaaagatggcggtcttggcacctctaattgctctcgtgtattcggysccgcgactttcacgatggctcgcccaaccttactaccttctgtcgsccctgctctctgmtgccttcctactcgtgaggmaactgccgccgctctgccacggtctgcccacccaacgcgaasmcggtaacccgtcrwsaytttgactgggtgagcctcccgcgtgttagtaccccgcgacsktgactgtscctgcccttgcaggtgtatctgggaaccctggggtttacctctctgaggacacctgakgttccgagcctgtagcggacttagagactattawktgcagggtccgaaccatcatcgagtctaaactttgtgtttaagatgggaaaacggaacatgttagtcgtagcccatgcacaacggcccaacagcttttgactgttgagtccaggtttctttctgtttcaccattgag

SEQ ID NO: 776 - DNA, 368 bp, Homo sapiens
  CDS 220..363
  sig_peptide 220..270: Von Heijne matrix score 6 seq WLSCFLLPALVVS/VA
  misc_feature 201: n=a, g, c or t Oligonucleotide
agagggtgcccacctgtgtgccagcgcctgtccggcgcctgcctgccgcctccgtggcgaaggggacacagaaatactcactgagcctacactgggctcagcctgtgcttggtcctggggtcacaaaggtgcatcagacgcagaccttgccctcacatctcttctggcctggtgggagaggctcatctgcaaagagataangaggtccctgcggatgtgatggcccagctatggctgtcctgcttcctccttcctgccctcgtggtgtctgtggcagccaacgtggcccckwagttcctagccaacatgacgtcagtgatcctgcctgaggactgcctgtgggtgcccaggccttctggttggtagcg

SEQ ID NO: 777 - DNA, 469 bp, Homo sapiens
  CDS 8..322
  sig_peptide 8..109: Von Heijne matrix score 5.90000009536743 seq MAVLAPLIALVYS/VP
  misc_feature 233,352: n=a, g, c or t Oligonucleotide
agtcgttatggtgggggaggcggggcgagacctacgacgccggcgagcagtggccgttacggccgaaaagatggcggtcttggcacctctaattgctctcgtgtattcggtgccgcgactttcacgatggctcgcccaaccttactaccttctgtcggccctgctctctgctgccttcctactcgtgaggaaactgccgccgctctgccacggtctgcccacccaacgcgarnacggtaacccgtgtgactttgactggagagaagtggagatcctgatgtttctcagtgccattgtgatgatgaagaaccgcagatccagctgaatttgaacttggacttctatcccytmngwgtctcctatttcaaagtgccccatgaagagggacaaagaatgggatataggagtgcacagcccagcctgacctgtgacatctctgtgtttcagtcactgtggagcaacatatagg

SEQ ID NO: 778 - DNA, 468 bp, Homo sapiens
  CDS 77..340
  sig_peptide 77..133: Von Heijne matrix score 5.90000009536743 seq AFLVCLAFSLATL/VQ
agctcckcctcggcctccccttcgggcgctctcgcgctaactgtgctcctccggggccctccgcctgctcccagccatggtggcctggcgctcggcgttccttgtctgcctcgctttctccttggccaccctggtccagcgaggatctggggactttgatgattttaacctggaggatgcagtgaaagaaacttcctcagtaaagcagccatgggaccacaccaccaccaccacaaccaataggccaggaaccaccagagctccggcaaaacctccaggtagtggattggacttggctgatgctttggatgatcaagatgatggccgcagaaaccgggtataggaggaagagagagatggaaccatgtaaccaccacgaccaagaggccagtaaccaccagagctccagcaaatactttaggaaatgattttgacttggctgatgcctggatgatcgaaatgatcgag

SEQ ID NO: 779 - DNA, 479 bp, Homo sapiens
  CDS 73..429
  sig_peptide 73..231: Von Heijne matrix score 5.80000019073486 seq ILSLQVLLTTVTS/TV
gctctctcgcggaastggggaggaggcggttgcggttagtggaccgggaccggtaggggtgctgttgccatcatggctgaccccgacccccggtaccctcgctcctcgatcgaggacgacttcaactatggcagcagcgtggcctccgccaccgtgcacatccgaatggcctttctgagaaaagtctacagcattctttctctgcaggttctcttaactacagtgacttcaacagtttttttatactttgagtctgtacggacatttgtacatgagagtcctgccttaattttgctgtttgccctcggatctctgggtttgatttttgcgttgaytttaaacagacataagtatccccttaacctgtacctactttttggatttacgctgttggaagctctgactgtggcagttgtkgttactgttctatgatgtatatattattctgcaagctttcatactgactactacagtatttt

SEQ ID NO: 780 - DNA, 504 bp, Homo sapiens
  CDS 112..423
  sig_peptide 112..276: Von Heijne matrix score 5.59999990463257 seq ELCCLFCCPPCPG/KI
agtttcttccgggtcattgacagaagcgtcaattcctgggagtagttcgttggttttctttcccctcatccttttgcctgctcccggcgaggggtggctttgatttcggcgatgagctcccagaaaggcaacgtggctcgttccagacctcagaagcaccagaatacgtttagcttcaaaaatgacaagttcgataaaagtgtgcagaccaagagcatgaataatctttcatttagtgagctatgttgcctcttctgctgtccaccttgtccagggaagattgcttcaaaattagcgtttttgccacctgatccaacttacacactgatgtgtgatgaaagcggaagcgttggactttacatctgtctgaacgagcagactggcagtattcttctagagaaaaagatgctattgagtgtttcatgactagaaccagtaaaggcaacagaattgcttgtatgtttgtacgttgttcacccaatgcgaaatacactttactcttct

SEQ ID NO: 781 - DNA, 544 bp, Homo sapiens
  CDS 102..479
  sig_peptide 102..287: Von Heijne matrix score 5.59999990463257 seq VIYLILLTAGAGL/LV
  misc_feature 521: n=a, g, c or t Oligonucleotide
agctgcagtggttcgatgggaaggatctttctccaagtggttcctcttgaggggagcatttctgctggctccaggactttggccatctataaagcttggcaatgagaaataagaaaattctcaaggaggacgagctcttgagtgagacccaacaagctgcttttcaccaaattgcaatggagcctttcgaaatcaatgttccaaagcccaagaggagaaatggggtgaacttctccctagctgtggtggtcatctacctgatcctgctcaccgctggcgctgggctgctggtggtccaagttctgaatctgcaggcgcggctccgggtcctggagatgtatttcctcaatgacactctggcggctgaggacagcccgtccttctccttgctgcagtcagcacaccctggagaacacctggctcagggtgcatcgaggctgcagtcctgcaggcccaactcacctgggtccgcgtcascatgagcacttgctgcagcgggtagacaacttcactcagaakcnacggatgttcagaatcaaaaggt

SEQ ID NO: 782 - DNA, 455 bp, Homo sapiens
  CDS 27..428
  sig_peptide 27..194: Von Heijne matrix score 5.30000019073486 seq LAKLLPLPAAITS/QL
aagagaggaaaaaaaatagcaggaagatggcgcccaccaagcccagctttcagcaggatccttccaggcgagaacgtttacaagcattgagaaaggagaaatcccgagatgctgctcgctcccgccggggaaaagaaaactttgagttctatgaattggccaagttgttgcctcttcctgcagccattaccagccagctcgacaaggcatccatcattcgacttacaattagctatctgaaaatgagggactttgctaaccagggggaccctccgtggaacttgcgaatggaaggccctccacctaacacatcagtaaaagttataggtgcacagcgaaggagaagccccagtgcactagccattgaagtatttgaagcacatttgggaagccacattttgcagtcctggatggctttgtatttgcactaaatcaggaaggaaaatttttgtaca

SEQ ID NO: 783 - DNA, 453 bp, Homo sapiens
  CDS 85..168
  sig_peptide 85..144: Von Heijne matrix score 5 seq ALLSVCSTDVTTA/HA
  misc_feature 284: n=a, g, c or t Oligonucleotide
ccccttgtggccaagcctggaacatcacatctgtacgttgcaatctgtggatcagctacgagactgagagaaaggaatgaaaggatggaagaattacaagatcaggcactgctgtctgtctgttccacggatgtaaccacagcacacgcgtggctcacggtactagtgtgataaatgcttgttacatgaaggcgtgaacagggatgagaagagacttcctggagaaacaaaaggactaacaatcaggaaggggaggtgatcggggcaggagtaaagtggacacntcagctggtcccctgggtcgtccacccgatgtcccccattctccccacttggcctcccccacaggctctcggcaaaggaccgtgggaggcacctgtgacactgcccttttcctgtgcagctgtttktcttcttcattcttttcactcctcgttactcttttttttttca

SEQ ID NO: 784 - DNA, 587 bp, Homo sapiens
  CDS 85..168
  sig_peptide 85..144: Von Heijne matrix score 5 seq ALLSVCSTDVTTA/HA
ccccttgtggccaagcctggaacatcacatctgtacgttgcaatctgtggatcagctacgagactgagagaaaggaatgaaaggatggaagaattacaagatcaggcactgctgtctgtctgttccacggatgtaaccacagcacacgcgtggctcacggtactagtgtgataaatgcttgttacatgaaggcgtgaacagggatgagaagagacttcctggagaaacaaaaggactaacaatcaggaaggggaggtgatcggggcaggagtaaagtggacacctcagcaaagccattcgctgtgatctctgattgtgcagtgtcatgtcctgtcaccagagccccctcgtgtttgrkgttggccaatgccgccagcatgatctagcaggccaaatcctaatctaccattctctgacaccagctggtcccctgggtcgtccacccgatgtcccccattctccccacttggcctcccccacaggctctcggcaaaggaccgtgggaggcacctgtgacactgcccttttcctgtgcagctgtttktcttcttcattcttttcactcctcgttactcttttttttttca

SEQ ID NO: 785 - DNA, 461 bp, Homo sapiens
  CDS 250..390
  sig_peptide 250..384: Von Heijne matrix score 4.80000019073486 seq ICCAAAAAAAAGS/RI
  misc_feature 218: n=a, g, c or t Oligonucleotide
agaggcctcgcgaggcagggctagaagctgtggcctcacccttgaggcccgggcacttcccgtctcctcccttgctccccttcctcaccccaatccctacagcctcccgcgcasctgagctctaggattgtgggttttccatcctccgaagacatcacctttgctcatctcccaggagagtctcgtccaaaggaggggggtgctttctgcttcagcangatccaccccaccctgggatccgagggagcaatggtggggcgagtgagggtctgccgtaaatatcccccgaccaccctctgggaaggtgctagaggccacaggcaaatttcagtctccccatggaatatctgctgtgctgctgctgctgctgctgctgctgggtcaaggatatgagcgagcctcttcygaaaacagccgggaagggagaggaatccaagaggaggagcaggtgggaaagacaa

SEQ ID NO: 786 - DNA, 489 bp, Homo sapiens
  CDS 53..463
  sig_peptide 53..208: Von Heijne matrix score 3.90000009536743 seq LCCGLSMFEVILT/RI
cattttctgctctgcgactccttttgcagagggggagcgcctggaggtccggatgaaacgtctggaagccaagtatgccccgctccacctggtccctctgatcgagcggctggggacccctcagcaaatcgccattgctcgcgagggtgacctcctgaccaaggagcggctgtgctgtggcctgtccatgttcgaggtcatcctgacccgcattcggagctacctgcaggaccccatctggcggggcccaccgcccaccaatggcgtcatgcacgtcgatgagtgtgtggagttccaccggctgtggagcgccatgcagttcgtgtactgcatccctgtgggaaccaacgagttcacagctgagcagtgtttcggcgatggcttgaactgggctggttckccrkcattgtcctgctsggccagcagcgtcgctttgacctgttcgacttctgttaccacctgctaaaagtgcagaggcaggacgggaag

SEQ ID NO: 787 - DNA, 397 bp, Homo sapiens
  CDS 52..354
  sig_peptide 52..264: Von Heijne matrix score 3.70000004768372 seq LXDLSSLLTRGSG/NQ
ccctcacgcccgccctccttgccgcccagccggtccaggcctctggcgaacatggcgcttgtcccctgccaggtgctgcggatggcaatcctgctgtcytactgctctatcctgtgtaactacaaggccatcgaaatgccctcacaccagacctacggagggagctggaaattcctgacgttcattgatctggttatccaggctgtcttttttggcatctgtgtgctgamtgatctttccagtcttctgactcgaggaagtgggaaccaggarcaagagaggcagctcaagaagctcatctctctccgggactggatgttagctgtgttggctttcctgttggggtttttgttgtagcagtgttctggrtcatttatgcctatgacagmgagatgat

SEQ ID NO: 788 - DNA, 595 bp, Homo sapiens
  CDS 50..286
  sig_peptide 50..256: Von Heijne matrix score 3.70000004768372 seq ALTGSQLLGDTIP/RP
ctctctgtccccctccccctccctgtccttatctttcccttctgtctccatggcgactcaccacctcggcttgcctgcatcccagcctctgccagggattctgagccgggctccatccctccctcctcggagccctgctacccgcagccgtgtctcctccccctggggtgagtccagcagcagcctcctctttcctgactgtcacatttcttttccagctctgaccgggagtcagctcctcggggataccatcccccgacctcaccttccacctaccgcagcctgctagcctttccgggagaaaaggcatccttacctctggttgaaggtctcggggcctccccctctgcatccggaccctctccccatcccagcctcccatgccaaggcccgccttgtcagtcacttccttttgtcatcggcttggcaaacgggagagaaaacagagcttcatgggaaacagcggcaacagtggtcccatacacctttccccaagttggagctaggcctggggccccagcccatggygccccgggagctccctacctgctccatstgcctggagaggttgcgcgaccccatctsgytggaatgt

SEQ ID NO: 789 - DNA, 359 bp, Homo sapiens
  CDS 21..344
  sig_peptide 21..125: Von Heijne matrix score 3.70000004768372 seq SPLLCHSLRKTSS/SQ
aggctcggggagtcggcgccatgaccccatcgaggcttccctggttgcttagctgggtctcggccacggcgtggagagcggcaagatcaccccttctgtgtcattctctgaggaaaacaagttcttctcaaggaggaaagtctgaacttgtcaaacagtcccttaagaagccgaagttaccagaaggtcgttttgatgcaccagaggattcccatttagagaaagaaccactggaaaaatttccagatgatgtkratccagtgaccaaagaaaaaggtggacccaggggcccagaacctacccgatatggagattgggaacgaaaaggacgctgtattgatttttaagtcgcatattct

SEQ ID NO: 790 - DNA, 836 bp, Homo sapiens
  CDS 118..360
  sig_peptide 118..270: Von Heijne matrix score 3.59999990463257 seq ICFVCGVFFSILG/TG
  misc_feature 7,359: n=a, g, c or t Oligonucleotide
aggaagnsggcgggaccggacttccggctggtctgtggggtttcgggttcggggtttcctggtgggcgtcaggggcaggcaacagagtggcggccgctacggccctggaacggggccatggagaagctgcggcgagtcctgagcggccaggacgacgaggagcagggcctgactgcgcaggtcctggatgcctcatcccttagtttcaacaccagattgaaatggtttgccatctgcttcgtatgtggcgttttcttttctattcttggaactggattgctgtggcttccgggcggcataaagctttttgcagtgttttataccctcggcaatcttgctgcgttascagtacatgcttnwtaatgggacctgtgaagcaactgaagaaaatgtttgaagcaacaagattgcttgcaacaattgttatgcttttgtgtttcgtatttaccctgtgtgctgctctttggtggcataagaagggactggctgtgttattctgcatattgcagttcttgtcaatgacctggtatagcctgtcrtacatcccatatgcaagggatgcagttattaaatgctgttcttctctcctaagttgaaaatcagaaacttgtggaaaagagcacttgaatgttggtactctatgtttggtgaagtttgcttttccccataaaacactccaggaacaactgacgtgacagttgaagaccgttttgtactaagtctcattttgtatactggtaaaaactacatgcttgattaaaccattaaatgcttgtaactttaaattcattatgtgtcattaatatacttttccaaagataagatttttaatcact

SEQ ID NO: 791 - DNA, 551 bp, Homo sapiens
  CDS 6..329
  sig_peptide 6..284: Von Heijne matrix score 3.59999990463257 seq LLRLALRSPDVWL/GQ
  misc_feature 496,536: n=a, g, c or t Oligonucleotide
tgtgtatgtgtgaaaatcaggaagagccagcggggagtgtgtgttgccatcgcgtctccgcctgcaggggcgggaccccaggaggagggagaggacagagccactgcagaggaccagactgggaaaacaacgatatggcaggagccagtcttggggcccgcttctaccggcagatcaaaagacatccggggatcatcccgatgatcggcttaatctgcctgggcatgggcagcgctgcgctttacttgctgcgactcgcccttcgcagccccgacgtctggctgggacagaaagaacaacccggagccctggaaccgcctgagccccaatgaccaatacaagttccttgcagtttccactgactataagaagctgaagaaggaccggccagacttctaagccaggctgggctgccagtgccatgcaagccacagccagccagcccatccacttcttccactcctccccgcaggccccaaggcatcactccggccancctgtcccgctactgcttacacaggccgggttccaccsanaggggargctgctcc

SEQ ID NO: 792 - DNA, 437 bp, Homo sapiens
  CDS 31..432
  sig_peptide 31..78: Von Heijne matrix score 3.5 seq AGLALLXRRVSSA/LK
ggaaacgcgttttgccagttatgcgaaaacatggctgcggccggtttggcccttcttkgtaggagagtttcatccgccctgaaatcttcccgatcgttaataactcctcaggtccctgcctgcacagggttttttcttagtttgttgcctaagagtacaccaaatgtgacatcctttcaccaatatagattacttcataccacattgtcaaggaaaggactagaagaattttttgatgacccaaaaaactgggggcaagaaaaagtaaaatctggagcagcatggacctgtcagcaactaaggaacaaaagtaatgaagatttacacaaactttggtatgtcttactgaaagaaagaaacatgcttctaaccctagagcaggaggccaagcggcaragattgccaatgccaagtccagagcggttagataggtagta

SEQ ID NO: 793 - DNA, 350 bp, Homo sapiens
  CDS 130..321
ggaagtggacgaatttgaatcctgtgggccgttgaatgtggctgctcgcggtcggcgtgccccgacgtacagcgggccgggaaaagtggcactgaggctctggaacttctgcccagctctccttgtaaaatgaatgaaagtaaacctggtgactcacagaaccttgcttgtgttttctgtcgaaaacatgatgactgtcctaataaatacggagaaaagaaaactaaggagaaatggaatctcactgtacattactactgtttgttgatgtcaagtggaatttggcagagaggcaaagaagaagaaggagttatggttttctaatagaagatatcaggaaggaagtgaat

SEQ ID NO: 794 - DNA, 431 bp, Homo sapiens
  CDS 37..273
gcgcatgtgcagaagggaaacgtgaagaaggtgaagatggcggtggccagggccggggtcttgggagtccagtggctgcaaagggcatcccggaacgtgatgccgctgggcgcacggacagcctcccacatgaccaaggacatgttcccggggccctatcctaggaccccagaagaacgggccgccgccgccaagaagtataatatgcgtgtggaagactacgaaccttacccggatgatggcatggggtatggcgaccttttcctgtwtgtctgatttttattatttaaaaaaatggaaaaacaaaagtgcatttttcattcaataaatgttccatccttatttagttttgttgaatcaagtcactttttacaagttttgtttgatatgtattttcatgctgttaacacatttttctctgtcattatatt

SEQ ID NO: 795 - DNA, 516 bp, Homo sapiens
  CDS 140..337
agagtgcattccggaacccggggcgcggcgcactgcgcaggcggccggactccgctcagtttccggtgcggcgaacaccaaagtccgggaacttaagcattttcggtttctagggttgttacgaagctgcaggagcgagatggaggtggacgcaccgggtgttgatggtcgagatggtctccgggagcggcgaggctttagcgagggagggaggcagaacttcgatgtgaggcctcagtctggggcaaatgggcttcccaaacactcctactggttggacctctggcttttcatccttttcgatgtggtggtgtttctctttgtgtattttttgccatgacttgttcgctgatatctaaattaagaagttggttcttgagtgaattctgaaatggctacaaacttcttgaataaagaagacaggactctcaatagaagaatttcacatctccaagggaccttcctttcattttacactttgttactaatttgcagaactctattaattgggtagga

SEQ ID NO: 796 - DNA, 442 bp, Homo sapiens
  CDS 40..174
cctggtttttttgttttttgtttggggtatttttggtgtatgtatgtttatgtatgtgtgtgggtatgtgtgtatacagtggagagcaaattggaaaacagttctatttatcctcctccctccccagtagaaawaaaaaaaatctttacatttgttacttttcttttccccccgtaagacacagaattaatggaaagtgagtatcttggatttcaaatctgaagagatttttaccattagtggtttgattttaatttgcttggttaactatcatatttttcatacacttctctggatttaaaatatcttgaggtattttgccactggcttcatgctggagtaatgggtaacatatctttggtatggttgcttagattaacttacctagtcagacccagaagaacttcttttactagcttgcttcctaaatgcttttttcctc

SEQ ID NO: 797 - DNA, 420 bp, Homo sapiens
  CDS 221..295
acaaacggcggcgccggggccggaggaaaaagctcgccaccctgaagggtcccttcccaagcccttagggaccgcagaggacttggggaccagcaagcaacccccagggcacgagaagagctcttgctgtctgccstgcctcaccctgcmccacgccaggcccggtggcccccagctgcatcaagtggaggcggaggaggaggcggaggagggtggcaccatgggcccgggcggtgccctccatggggggatgaagacactgctgccatggacagcccgtgccagccgcagcccctaagtcaggctctccctcagttaccagggtcttcgtcagagcccttggagcctgagcctggccgggccaggatgggagtggagagttacctgccctgtcccctgctcccctcctaccactgtcca

SEQ ID NO: 798 - DNA, 413 bp, Homo sapiens
  CDS 79..372
  misc_feature 364..365: n=a, g, c or t Oligonucleotide
atggggacggggctgttcccggggaggctgtgatgggttgacaggtgcgtgacagtgggagctgctctcggcacaagcatgtacggcaaaggcaagagtaacagcagcgccgtcccgtccgacagccaggcccgggagaagttagcactctacgtatatgaatatctgctccatgtaggagctcagaaatcagctcaaacatttttatcagagataagatgggaaaaaaacatcacattgggggaaccaccaggattcttacattcttggtggtgtgtattttgggatctctactgtgcagctccagagagacgtgaaacatgtgaacactcaagtgaagcaaaagccttccatgattacgtanntaacatataattttacaaagttacactgtcagttttctgtttaaccac

SEQ ID NO: 799 - DNA, 401 bp, Homo sapiens
  CDS 46..195
actgcagagaaccagacaataccaggttgcttataaaaggatgccatgtgcttgctggaggtcccaggtgcaaccaaattgcttgcagctaggaggaccttgaagagaaatgggatcagcccgccaaaccaagaagggttagcacttttgctaggagagctgaccacgcacaaacagatgagaaccaaaaccgagtgaagaggattgaagatgaacccacattttaaaagttcttgtctgctggaggtggcattacctgtgacctcgcttcacttctccatacatggctgttatagcagaaaatccagctttctgaagcatatttcacgacatatgatgagacttatgtgatgtgagacctgagaaaactatgatagamagaagcaactcaagttgcaagg

SEQ ID NO: 800 - DNA, 465 bp, Homo sapiens
  CDS 96..191
agagccgcccaagggatggcgatggcgtacttggcttggagactggcgcggcgttcgtgtccgaggtcactagtttcccggtagttcagctgcacatgaatagaacagcaatgagagccagtcagaaggactttgaaaattcaatraatcaagtgaaactcttgaaaaaggatccaggaaacgartgmagctaaaactctacgcgctatataagcaggccactgaaggaccttgtaacatgcccaaaccaggtgtatttgacttgatcaacaaggccaaatgggacgcatggaatgcccttggcagcctgcccaaggaagctgccaggcagaactatgtggatttggtgtccagtttgagtccttcattggaatcctctagtcaggtggagcctggaacagacaggaaatcaactgggtttgaaactctggtggtgacctccgaagatggcatcacaaagatcat

SEQ ID NO: 801 - DNA, 629 bp, Homo sapiens
  CDS 144..317
  misc_feature 583..584: n=a, g, c or t Oligonucleotide
agtccatcccctgtgcccgggaaccgcggctctgccccgcaaagggcacgcggactacaactcccagagtccactgcagcggccaagggctactgttcccagcgaggcccgsssggcggcaccgcgaagggaggagtggcaacatggcgtcttcgggagctggtgaccctctggattctaagcgtggagaggccccgttcgctcagcgtatcgacccgactcgggagaagctgacacccgagcaactgcattccatgcggcaggcggagttgcccagtggcagaaggtcctaccacggcggcgaacccggaacatcgtgaccggcctaggcatcggggccctggtgttggctatttatggttacaccttctactcgatttcccaggagcgtttcctagatgagctagaagacgaggccaaagctgcccgagcccgagctctggcaagggcgtcagggtcctaatctggatgggtattgatcatgtccaacctgctggagccccttcacatggtggatgatgccccatgaccctgtgagaaattgaatcctgctcacaacattgttggccttcttactaacctnngacctgattgagcccaagaaaccagggasttacgcatttggccaa

SEQ ID NO: 802 - DNA, 477 bp, Homo sapiens
  CDS 169..462
atataagtggaggtcatttcccctgcccccacccccagcttcctcagatctgggcagaggaaccaaagggaaaagccaccttcccaggcacagccataacatccacctcactcaactgcttgtcaagttcaccaccaacacagagggggctcagataatcaagaaacaatgtcgagtgatgataaaagtaaatcaaatgaccccaagactgagcccaagaactgcgatcccaagtgtgaacaaaagtgtgagtccaaatgccagcccagctgtttaaagaagctgctgcaacgctgtttcgaaaagtgcccatgggaaaagtgtccagcaccacccaagtgcctgccctgcccctcgcagtctccttcatcctgccctccccagccctgcaccaagccctgtcctcctaaatgcccttcatcctgcccacatgcttgcccamctccctgccctcccccagagtgaggcactgtgggc

SEQ ID NO: 803 - DNA, 586 bp, Homo sapiens
  CDS 179..307
cggtagtsagaacccttccggtgggctaggtactgagcgcgcgaggtgaggagttgtgcagggtwtggggaaaggaaggctggcttggcgagagggcaggtttgcgggctttcgcccccttttccaaagaccaacaaagagtccttccccaactcccaactcaaccccttttggaactatgtgtggtggttgggaccctgtggcgcatccttgtcgctcgtgtccttctcatgcccggcgacgcgtctttgtggtaacgccctgctgccatctcttttcttctctatgcgaggatttggactggcagtgagaataagagacaacgattcacgtctactttctaggatgacttccatgtgctccatctcgcgcgtccctgagcatgttgaatttccaaatcctaaataagccgcgcggtgtagtttgtattatgttgcgtttctctttctgcttttcctcgccctttctccatcatcctttaggctctacagagtgaaggtttaaatccaaggtcatggcaaaacatctgaagttcatcgccaggactgtgatggtacaggaagggaacgtggaaagcgcatacagg

SEQ ID NO: 804 - DNA, 559 bp, Homo sapiens
  CDS 78..548
acgtcattcacccgcgccacccggaagccgcggttcctaccwaccgttcttattgctggcggcctgaggagcccatcatggcgacgccccctaagcggcgggcggtggaggccacgggggagaaagtgctgcgctacgagaccttcatcagtgacgtgctgcagcgggacttgcgaaaggtgctggaccatcgagacaaggtatatgagcagctggccaaataccttcaactgagaaatgtcattgagcgactccaggaagctaagcactcggagttatatatgcaggtggatttgggctgtaacttcttcgttgacacagtggtcccagatacttcacgcatctatgtggccctgggatatggttttttcctggagttgacactggcagaagctctcaagttcattgatcgtaagagctctctcctcacagagctcagcaacagcctcaccaaggactccatgaatatcaaagcccatatccacatgttgctagaggggcttagagaactacaaggcctgcagaatttcccagagaagcctcaccattgacttcttcc

SEQ ID NO: 805 - DNA, 570 bp, Homo sapiens
  CDS 122..478
aaacacatccaagcttaagacggtgaggtcagcttcacattctcaggaactctccttctttgggtctggctgaagttgaggatctcttactctctaggccacggaattaacccgagcaggcatggaggcctctgctctcacctcatcagcagtgaccagtgtggccaaagtggtcagggtggcctctggctctgccgtagttttgcccctggccaggattgctacagttgtgattggaggagttgtggctgtgcccatggtgctcagtgccatgggcttcactgcggcgggaatcgcctcgtcctccatagcagccaagatgatgtccgcggcggccattgccaatgggggtggagttgcctcgggcagccttgtggctactctgcagtcactgggagcaactggactctccggattgaccaagtkcatcctgggctccattgggtctgccattgcggctgtcattgcgaggttctactagctccctgcccctcgccctgcagagaagagaaccatgccaggggagaaggcacccagccatcctgacccagcgaggrgcaactatcccaa

SEQ ID NO: 806 - DNA, 384 bp, Homo sapiens
  CDS 90..332
aaacacatccaagcttaagacggtgaggtcagcttcacattctcaggaactctccttctttgggggctcaccgtgtgggggagcaaatcatgtatatccagtgctgtgagtggctccagtcatggaggagcaaggatgagttctgcctggaagaatctgggaaggcttcctggaggagggaacaatggcatggaccttgddgagtcagaagctttcaattcattccattcaagcattgctctcatgtggcattcaagcattctatagtgcttgccgtgactcaggcgcacagtgcaaaaggaagcacatctttctctgccatgaggacttattagtgtctgaagagctttttctggactataggagaaagtcatggtctccctc

SEQ ID NO: 807 - DNA, 371 bp, Homo sapiens
  CDS 152..346
  misc_feature 302..303: n=a, g, c or t Oligonucleotide
aaggttacttgactgggagttctcagacctccagtttcagccctgccctcagcctccaatccgtaagagacacccagccccagcaattggattgggcagcccgtcttgacacrccastgtgcygagtggcttgaaggacgtgtttcaacagatggttggggttagtgtgtgtcatcacattcgagtggggattaagagaaggaaggctgccttgctggagctgtgtggtcttctccaagtgagagtcgcaggcaatagaactactttgcttttggaggaaaagmggaattcattttcagcanncacragaaaagcagtttttttttcaggggatcttcacttctcttgaacaaggaactcactcagagact

SEQ ID NO: 808 - DNA, 435 bp, Homo sapiens
  CDS 98..430
cgacaggagccctcaagctgatctggtcgggaccggatacattattaaccccagtgcagtagggtccccaggggcaacctgccccacagcgcccaagatgcctagcagaactgcccgctatgcccgctacagcccacggcagcggcggcggcggatgctggctgatcgcagcgtgcgtttccctaatgatgtcctgttcttggaccacatccggcagggtgacctggagcaggtggggcgcttcatccggactcggaaagtctccctggccaccatccacccctcaggcctggccgccttgcatgaagccgtgctctctggaaacctggaatgcgtgaagctgctggtcaaatacggggctgacattcaccagcgagatgaggcgggctggacacccctgcacattgcctgcagcgatgggtacctgacatagcc

SEQ ID NO: 809 - DNA, 394 bp, Homo sapiens
  CDS 149..247
  misc_feature 375: n=a, g, c or t Oligonucleotide
attcatttggtgggcacttcctgggtgcctgctctgggtcaggcctgtggggkggaccactgagggcaggaaacctggcctgtccctccaggaagcgaagtcaacactggcacctgcagatgaagtggcagagcagcccccagctttgatggcatggggtggttggggggcacattctgcatgctcagaagagagagcaactcgccctgtggaaggagcatacagtgggagatggggacaggcccagtgacgagcaccatccggaagtgaaggctgatgggtacgtggacaacctcgcagagcagtggacctgctgctgcagcacgccgacaagtgatggcctcctgggagagccccgctcctccacccctgccnctcctccacctgccccctg

SEQ ID NO: 810 - DNA, 835 bp, Homo sapiens
  CDS 198..536
  misc_feature 511,749..750,790..791,807: n=a, g, c or t Oligonucleotide
agacttggtttgtgggacacacttggtttcagggaaggggaaagaggtcaccaagggcagaggtgtccaggccggagccaggggccccactgttgggatgctggctgcagtggggcgccccaagcccaggtcccctctgtcttctctttcgactttgcagctgtacttgttttgctcctctacccgcaggagctgacatggacccaaatcctcgggccgccctggagcgccagcagctccgccttcgggagcggcaaaaattcttcgaggacattttacagccagagacagagtttgtctttcctctgtcccatctgcatctcgagtcgcagagaccccccataggtagtatctcatccatggaagtgaatgtggacacactggagcaagtagaacttattgaccttggggacccggatgcagcagatgtgttcttgccttgcgaagatcctccaccaaccccccagtcgtctggggtggacaaccatttggaggagctgagcctgccggntgcctacatcagacaggaccacatctaggacctcctcctcctcctcctccgactcctccaccaacctgcataggccaaatccaagtgatgatggagcagatacgcccttggcacagtcggatgaagaggaggaaaggggtgatggaggggcagagcctggagcctgcagctagcagtgggcccctgcctacagactgaccacgctggctattctccacatgagaccackagcccamknnagagcctgtcgggagaagaccagactctttacttgcagtnnraccagaggtgggaangatggtgggattgtgtacctttctaaga

SEQ ID NO: 811 - DNA, 385 bp, Homo sapiens
  CDS 21..194
  misc_feature 373: n=a, g, c or t Oligonucleotide
aagtcacatgagccaccaaaatggtggtgttcgggtatgaggctgggactaagccaagggattcaggtgtggtgccggtgggaactgaggaagcgcccaaggacacaaaatatatatcaaatggcgacatttggaacaacagctggtttctctggaatattctcaaacttcctgttcagacgctgcttcaaggttaaacatgatgctttgaagacatatgcatcattggctacacttccatttttgtctactgttgttactgacaagctttttgtaattgatgctttgtattcagataatataagcaaggaaaactgtgttttcagaagctcactgattggcatagtttgtggwgttttctatcccagttctntggcttttacta

SEQ ID NO: 812 - protein, 90 aa, Homo sapiens
  SIGNAL -14..-1
MLLPLLLLLPMCWAVEVKRPRGVSLTNHHFYDESKPFTCLDGSATIPFDQVNDDYCDCKDGSDEPGTAACPNGSFHCTNTGYKPLYIPSN

SEQ ID NO: 813 - protein, 80 aa, Homo sapiens
  SIGNAL -16..-1
MRLSLPLLLLLLGAWAIPGGLGDRAPLTATAPQLDDEEMYSAHMPAHLRCDACRAVAYQVSPSPLSPALLTPLLKPAPTG

SEQ ID NO: 814 - protein, 67 aa, Homo sapiens
  SIGNAL -22..-1
MDMRVPAQLLGLLLLWLRGARCGVQMTQFPLSLSASVGDRVTITCRTSHIINIFLNWYQQKPGKAPW

SEQ ID NO: 815 - protein, 50 aa, Homo sapiens
  SIGNAL -23..-1
MAAALWGFFPVLLLLLLSGDVQSSEVPGAAAEGSGGSGVGIGXRFKIEGL

SEQ ID NO: 816 - protein, 84 aa, Homo sapiens
  SIGNAL -22..-1
MDMRVPAQLLGLLLLWLXGARCDIQMTQSPVLPASVGDRVTITCRASQSIGSYLNWYQHKPGHAPRLLIYAATTLSRGGPARFS

SEQ ID NO: 817 - protein, 72 aa, Homo sapiens
  SIGNAL -32..-1
MAASRWARKAVVLLCASDLLLLLLLLPPPGSCAGRRSPXTPDESTPPPRKKKKDIRDYNDADMARLLEQGEG

SEQ ID NO: 818 - protein, 127 aa, Homo sapiens
  SIGNAL -19..-1
MELGLCWVLLLALLEGVQCDVELVESGGGLVQPGGSLRLSCAASGFNFSTYEMHWIRQAPGKGPEWVXYVSGGGGTXXNAXSVKGRFTISRDNANSFVYLQMDSLRVEDTALYYCARXDYDFWSGYY

SEQ ID NO: 819 - protein, 28 aa, Homo sapiens
  SIGNAL -19..-1
MAWTPLLLLLLSHCTGSLSQPVLTQPRG

SEQ ID NO: 820 - protein, 122 aa, Homo sapiens
  SIGNAL -19..-1
MEFGLNWVFLVALLRGVQCQVQLVESGGGVVQPGTSLTLSCAGSGFSFSDYGIHWVRQAPGKGLEWVAVISHDGNNKYYGGSMKGRVTISRDNSRHTVSLQMSSLGPEDTAVYYCAKDRTGG

SEQ ID NO: 821 - protein, 93 aa, Homo sapiens
  SIGNAL -19..-1
MKLLWFFLLLLAAPRWVLSQVQLVXSGPGLVKPSGTLSLTCTVXGXXITNYYWSXIRQSPGKGLEWIGTIYYSGSADHNPSLRSRATISLDTR

SEQ ID NO: 822 - protein, 48 aa, Homo sapiens
  SIGNAL -20..-1
MASLGLLLLXLLTALPPLWSSSLPGLDTAESKATXADLILSALERATG

SEQ ID NO: 823 - protein, 96 aa, Homo sapiens
  SIGNAL -28..-1
MDVGPSSLPHLGLKLLLLLLLLPLRGQANTGCYGIPGMPGLPGAPGKDGYDGLPGPKGEPGIPAIPGIRGPKGQKGEPGLPGHPGKNGPMGPPGMP

SEQ ID NO: 824 - protein, 143 aa, Homo sapiens
  SIGNAL -19..-1
MDCTWRILLLVAAATGTHAQVQLVQSGPEVKKPGASVKVSCQVSGYNVVELSIHWVRQSPGKGLEWMGGFDLESGETIYAQRFQGRITMTEDSSSDTAFMELISLRPEDAAVYYCATIRLPVVLFFAASGAREPWSPSPQXPR

SEQ ID NO: 825 - protein, 37 aa, Homo sapiens
  SIGNAL -18..-1
MWLPLVLLLAVLLLAVLCKVYLGLFSGSSPNPFSEER

SEQ ID NO: 826 - protein, 51 aa, Homo sapiens
  SIGNAL -25..-1
MELALRRSPVPRWLLLLPLLLGLNAGAVIDWPTEEGKEVWDYVTVRKDAYM

SEQ ID NO: 827 - protein, 131 aa, Homo sapiens
  SIGNAL -19..-1
MAWTPLFLFLLTCCPGSNSQAVXTQEPLTDCVPRXTVTLTCGSSIGAVTNGHFPYWFQQKPGQAPRTLISDTFNRQSSTPARFSGSLLGGKAVLTLSDAQPDDEAEYYCVLSYSGGRPVFGGGTKLTVLSQ

SEQ ID NO: 828 - protein, 25 aa, Homo sapiens
  SIGNAL -21..-1
MQACMVPGLALCLLLGPLAGAKPVQ

SEQ ID NO: 829 - protein, 79 aa, Homo sapiens
  SIGNAL -23..-1
MPSYKVCGVFCLFVCLFLSQSFAFVLQAGVQWRDLCSLQPQLPRFGPSSCLSLPSGWDCRRPPPRLANSCVFGGDGVSP

SEQ ID NO: 830 - protein, 59 aa, Homo sapiens
  SIGNAL -21..-1
MGTQEGWXLLLCLALSGAAETKPHPAEGQWRAVXVVLDXFLVKDXAHRGALASSEDRAR

SEQ ID NO: 831 - protein, 126 aa, Homo sapiens
  SIGNAL -16..-1
MSMLVVFLLLWGVTWGPVTEAAIFYETQXSLWAESEHXLKTLGQCDADVPGPPGDSRLPAVQEWGAQEPVHLDSPAIKHQFLLTGDTQGRYRCRSGLSTGWXQLSKLLELTGPKVLACSLALDGAS

SEQ ID NO: 832 - protein, 100 aa, Homo sapiens
  SIGNAL -19..-1
MLPSQLIGFLLLWVPASRGEIVLTQSPDFLSVTPKEKVTITCRASXSIGSSLYWYQQKPHQSPKLVIKYASQSFSGVSSRFSGSGSGTDFTLTINSLEPG

SEQ ID NO: 833 - protein, 115 aa, Homo sapiens
  SIGNAL -20..-1
MEKIPVSAFLLLVALSYTLARDTTVKPGAKKDTKDSRPKLPQTLSRGWGDQLIWTQTYEEALYKSKTSNKPLMIIHHLDECPHSQALKKVFAENKEIQKLAEQFVLLNLVYETTD

SEQ ID NO: 834 - protein, 119 aa, Homo sapiens
  SIGNAL -20..-1
MRPGLSFLLALLFFLGQAAGDLGDVGPPIPSPGFSSFPGVDSSSSFSSSSRSGSSSSRSLGSGGSVSQLFSNFTGSVDDRGTCQCSVSLPDTTFPVDRVERLEFTAHVLSQKFEKELSK

SEQ ID NO: 835 - protein, 147 aa, Homo sapiens
  SIGNAL -26..-1
MDLLHKNMKHLWFFLLLVAAPRWVRSQVQLXESGPGLVKPSGTLSLICGVSGDSVTISGWWSWVRQPPGKGLEWISEIDHGGNTNYNPSLKSRVXISLDKSKNKFSLRLTSVTAADTAMYXCARGGAXSSSAFDVWGLXTMVIISSA

SEQ ID NO: 836 - protein, 139 aa, Homo sapiens
  SIGNAL -19..-1
MDILCSTLLLLTVPSWVLSQVTLXESGPALVKATQTLRLTCTFSGFSLSTNRMRVSWIRQPPGKALEWLARIDWDDYKRYSTSLKTRVTISKDTSKNQVILTMTNVDPADTATYYCARLSTAATPQFFDFWGQGVLVSV

SEQ ID NO: 837 - protein, 139 aa, Homo sapiens
  SIGNAL -19..-1
MXHLWFFLLLVAAPRWVLSQVQLQESGPGLVKPSXTLSLTCTVSGDSISSYYWSWIRQPPGKGLEWIGYIYYSGSTNYNPSLKSRVTISVDTSKNQFSLKLSSVTAADTAVYYCARXLXYYDRSGYFRYFDYWGQGTWS

SEQ ID NO: 838 - protein, 136 aa, Homo sapiens
  SIGNAL -19..-1
MKHLWFFLLLVAAPRWVLSQVQLQESGPGLVKPSQTLSLTCTVSGGSIDSGNYYWSWIRQPAGKGLEWIGRIYSTGSTNYNPSLSSRVQISLDTSKNLLSLNLTSVTAADTAVYFCARTFPFYWYLDLWGRGILVT

SEQ ID NO: 839 - protein, 143 aa, Homo sapiens
  SIGNAL -19..-1
MKHLWFFLLLVAAPRWVLSQVQLQESGPRLVKPSQTLSLTCTVSGGSISSGGYFWSWIRQHPGRGLEWIGYIYYNWSTYYNPSLRSRVTMSMDTSKNQFSLNLNSVTAADTXMYYCARGRGRLGWFXXXGXGXPGHRLISRPG

SEQ ID NO: 840 - protein, 111 aa, Homo sapiens
  SIGNAL -19..-1
MKHLWFFLLLVAAPRWVLSQVQLQESGPGLVKPSETLSLTCTVSGGSIRTGSYYWTWVRQPPGKGLEWIGYIYYTGDTYYNPSLKSRITMSLDTXXNQFXLSLTSVTVADT

SEQ ID NO: 841 - protein, 53 aa, Homo sapiens
  SIGNAL -15..-1
MKLSVCLLLVTLALCCYQANAEFCPALVSELLDFFFISEPLFKLSLAKFDAPR

SEQ ID NO: 842 - protein, 23 aa, Homo sapiens
  SIGNAL -16..-1
MSPVLLVLSLSQCLLSDPVIPGL

SEQ ID NO: 843 - protein, 93 aa, Homo sapiens
  SIGNAL -19..-1
MKHLWFFLLLVAAPRWVLSQVRLQESGPRLVKPSEXLSLTCSVSGVSVTNFFWNWIRKPPGKGLEWLGYMSYGVSTNYHPAYQSRVSISIDTW

SEQ ID NO: 844 - protein, 139 aa, Homo sapiens
  SIGNAL -19..-1
MKHLWFFLLLVAAPRWVLSQVQLQEAGPRLVKPSEALSLTCTVSGVSSSNYDWSWIRQAPGKGLEWIGYIDDSKNRGSTTYNPSLKSRVTISXDTSKXQLSLRLTSVTXADTAVYYCARKSSMHSSGWHNRSLYWYFDP

SEQ ID NO: 845 - protein, 134 aa, Homo sapiens
  SIGNAL -26..-1
MDLLHKNMKDLWFFLLLVAAPRWVLSQVLQESGPGLVKPSGTLSLTCAVSGGSIISSNWWSWVRQTPGKGLEWIGEIYEDGITNYNPSLKSRVIISVDKAKNQFSLKMRSVTASDTAVYYCARGSSSVRTDYWG

SEQ ID NO: 846 - protein, 144 aa, Homo sapiens
  SIGNAL -19..-1
MKHLWFFLLLVAAPRWVLSQVQLQESGSGPVDXXQTLXLTCTXSGVSISSSDNCWSWIRQPPGKGLEWIGYIYHSGGTYYNPTLKSRVTISXDRIRNQFSLKLSSVTAXDTAVYXCGRAQGRMGIGTTIFDLWGGGQWSPSLQP

SEQ ID NO: 847 - protein, 140 aa, Homo sapiens
  SIGNAL -19..-1
MDWTWRILFLVAAATGAHSQVQLVQSGAEVKKPGASVKVSCKASGYXFTXXAXHWVRQAPGQRLEWMGWINAAXGXTXYSQXFQXRVTXTRDTSASTVSMELSSLRSEDTAVYFCARDWEIAVVPTAINSYGFDPGAREP

SEQ ID NO: 848 - protein, 52 aa, Homo sapiens
  SIGNAL -26..-1
MEARVERAVQKRQVLFLCVFLGMSWAGAEPLRYFVAEETERGTXLTNLAKDL

SEQ ID NO: 849 - protein, 134 aa, Homo sapiens
  SIGNAL -19..-1
MDWTWSILFLVAAATGAHSQVQLVQSGGEVKKPGASVKVSCKASGYTFTRYDINWVRQAPGQGLEWMGWISAXNGNTNYAQXVQGRVTMTTDTSTRTAYMELRSLRSDDTAIYYCAREIXVXXCDGQLGPGNLV

SEQ ID NO: 850 - protein, 140 aa, Homo sapiens
  SIGNAL -26..-1
MDVLHKHMKHLWFFLLLVAAPRWVLSQEQLRQWGAXLLKPSETLSLTCSVYGGSFNGYYWSWIRQSPGKGLEWIGGINHSGSTLSNPSLKSRVDLSVDASKDQVSLRLKLVTAADTAVYFCARPHYDMSTDSSFDGFDLW

SEQ ID NO: 851 - protein, 44 aa, Homo sapiens [sequence omitted]

SEQ ID NO: 852 - protein, 78 aa, Homo sapiens
  SIGNAL -19..-1
MDWTWRILFLVAAATGALSQVQLVQSGGEVKKPGASVRVSCKASGYSFIGYYVHWIRQTPGRXLEWMGWVNPXTGDNG

SEQ ID NO: 853 - protein, 44 aa, Homo sapiens
  SIGNAL -37..-1
MFFQFWKSSAYLIFVSICKGFLPVYLLLVLSLSLSLCCSLLLSL

SEQ ID NO: 854 - protein, 128 aa, Homo sapiens
  SIGNAL -19..-1
MDWTWRILFLVAAATGVHSQVHLVQSGAEVKKPGTPVNISCKAFGYTFPAFAIHWVRQAPGQSLEWMGWVNIGHGNTKYSQKFQGRLAISRDTSANIVYXELSGLRSEDTAVYYCARDNLFFGSMGFD

SEQ ID NO: 855 - protein, 152 aa, Homo sapiens
  SIGNAL -16..-1
MAWTVLLLGLLSHCTGSVTSYVLTQPPSVSVAPGKTASITCGGDNIESQVVHWHQQKPGQAPILVIYDDTDRPSGIPDRFSGSNSGHTATLTISRVEAGDEADYYCQVWDRSSGQGIFGGGTKLTVLRQPKAAPSVTLFPPSSEELQANKAT

SEQ ID NO: 856 - protein, 48 aa, Homo sapiens
  SIGNAL -15..-1
MRLLFLLLFVCFSRQGLALSLRLECSGMIMAYCSISLPGSSSPLTSAS

SEQ ID NO: 857 - protein, 74 aa, Homo sapiens
  SIGNAL -19..-1
MKHLWFFLLLVSAPRWVLSQVQLQESGPGLVKPSGRLSLACDVVELSPPAPRGGSAVHLRNLSSWEPHLQPVSG

SEQ ID NO: 858 - protein, 57 aa, Homo sapiens [sequence omitted]

SEQ ID NO: 859 - protein, 30 aa, Homo sapiens
  SIGNAL -19..-1
MEFGLSWVLLVAMLRGLQCQVQLVESGGTA

SEQ ID NO: 860 - protein, 57 aa, Homo sapiens [sequence omitted]

SEQ ID NO: 861 - protein, 31 aa, Homo sapiens
  SIGNAL -28..-1
MMRAFYLAILFCLSLSLWFXCLLFLLFAWPG

SEQ ID NO: 862 - protein, 102 aa, Homo sapiens
  SIGNAL -20..-1
MAWTPLLFLTLLLHCTGSLAQLVLTQSPSASASLGASVKLTCTLSSGHSNYGIAWYQQQPEKGPRFLMKVNSDGSHMKADGIPDRFSGSSSGAERYLSISSL

SEQ ID NO: 863 - protein, 18 aa, Homo sapiens
  SIGNAL -14..-1
MPLALFFLLSVALAIQGQ

SEQ ID NO: 864 - protein, 129 aa, Homo sapiens
  SIGNAL -19..-1
MDWTWRXFCLLAVAPGAHSQVQLVQSGAEVKKPGASVKVSCKASGYTFTSHYMHWVRQAPGQGLEWMGIIYPDSDTTKYXQNFQGRVTMTRDTSTSTVYMELSSLTSDDTAVYYCAREAYSGSYRFDYW

SEQ ID NO: 865 - protein, 124 aa, Homo sapiens
  SIGNAL -26..-1
MDLMCKKMRHLWFLLLLVAAPRWVLSQLQLQESGPGLVKASETLSLACSVSGDSISSGNYYWGWIRQPPGKGLQWLGSLWNRGGPQYNXSLKNRVTVSVDTSTNHFFLRLNSVNXGHGNLLLCA

SEQ ID NO: 866 - protein, 32 aa, Homo sapiens
  SIGNAL -16..-1
MRXXLXLSVLLGXXXXKXDFVGHQVLRISVAD

SEQ ID NO: 867 - protein, 38 aa, Homo sapiens [sequence omitted]

SEQ ID NO: 868 - protein, 110 aa, Homo sapiens
  SIGNAL -19..-1
MELGLSWLFLVAFLKGVQCEVQLLESGGGLVQPGGSLRLSCAASGFTFSSYAMLWVRQAPGKGLEWVSGISAGADDTYDADSVKGRFTISRDDSKKILYLQMNSLRAEDR

SEQ ID NO: 869 - protein, 60 aa, Homo sapiens
  SIGNAL -23..-1
MAVSVLRLTVVLGLLVLFLTCYADDKPDKPDDKPDDSGKDPKPDFPKFLSLLGTEIIENA

SEQ ID NO: 870 - protein, 106 aa, Homo sapiens
  SIGNAL -24..-1
MERRRLLGGMALLLLQALPSPLSARAEPPQDKEACVGTNNQSYICDTGHCCGQSQCCNYYYELWWFWLVWTIIIILSCCCVCHHRRAKHRLQAQQRQHEINLIAYR

SEQ ID NO: 871 - protein, 37 aa, Homo sapiens
  SIGNAL -27..-1
MVVADRNRASSSSYLCLLLFSLSLFLCHETVCDRATC

SEQ ID NO: 872 - protein, 142 aa, Homo sapiens
  SIGNAL -19..-1
MDWTWRFLFVVAAATGVQSQVQLVQSGAEVKKPGSSVKVSCKASGGTFSXYAISWVRQAPGQGLEWMGGIIPIFGTAXYAQKFQGRVTITADXSTXTXYMELSSLRSEDTAXYYCARGQAPGRVVVPLFLWGQGTWSPSPQP

SEQ ID NO: 873 - protein, 87 aa, Homo sapiens
  SIGNAL -45..-1
MTYSYSFFRPELIVNHLNYVHSEANRRTKTKTLLSLLSFLDETSGLSTHLPCLSLSKECGVLHLDIHGKKEDMRDEVLLALNXCTHR

SEQ ID NO: 874 - protein, 79 aa, Homo sapiens
  SIGNAL -19..-1
MKSFSRILFLVFLLAGLRSKAAPSAPLPLGCGFPDMAHPSETSPLKGASENSKRDRLNPEFPGTPYPEPSKLPHTVSLE

SEQ ID NO: 875 - protein, 51 aa, Homo sapiens
  SIGNAL -41..-1
MRVPIFPHPHQLSLLFIHLFIYLFRERVSLCHLGWSAVVQSQPTTTLTSRA

SEQ ID NO: 876 - protein, 44 aa, Homo sapiens [sequence omitted]

SEQ ID NO: 877 - protein, 26 aa, Homo sapiens
  SIGNAL -16..-1
MHTFLCLLFYLIVSCGAVFLTVPSPQ

SEQ ID NO: 878 - protein, 52 aa, Homo sapiens
  SIGNAL -39..-1
MAWHPTPPPLXXPPPLXRXSLPACADSIILXLXFPGILGQAHLXSEQWTQYL

SEQ ID NO: 879 - protein, 37 aa, Homo sapiens
  SIGNAL -21..-1
MPILPQDILHLLILLSGTCFTWILLWLPLSPLLGLKC

SEQ ID NO: 880 - protein, 85 aa, Homo sapiens
  SIGNAL -20..-1
MKALGAVLLALLLCGRPGRGQTQQEEEEEDEDHGPDDYDEEDEDEVEEEETNRLPGGRSRVLLRCYTXXSLPRDERCNLTQNCSH

SEQ ID NO: 881 - protein, 88 aa, Homo sapiens
  SIGNAL -15..-1
MKEYVLLLFLALCSAKPFFSPSHIALKNMMLKDMEDTDDDDDDDDDDDDDEDNSLFPTREPRSHFFPFDLFPMCPFGCQCYSRVVHCS

SEQ ID NO: 882 - protein, 95 aa, Homo sapiens
  SIGNAL -19..-1
MKHLWFFLLLVAAPRWAMSQVQLQESGPRLVKPSGTLSLTCSVSGGSMATSDWWSWFRQTPEKGLEWIGEIFQTGPTNYNPSLKSRVSMSVDMSK

SEQ ID NO: 883 - protein, 129 aa, Homo sapiens
  SIGNAL -26..-1
MDLTCKKMKHLWFFLLLVAAPRWALSQLQLQESGPGLVKPSETLSLTCTVSGESITTNSFCWAWIRQPPGKGLEWLGTVCYGGTTYXNXSLKSRVKLSLDTSTNQFSLKVTSMTAGDAAVHYCAGLRVS

SEQ ID NO: 884 - protein, 66 aa, Homo sapiens
  SIGNAL -63..-1
MANGTNASAPYYSYEYYLDYLDLIPVDEKKLKAHKHSIVIAFWVSLAAFVVLLFLILLYMSWSASP

SEQ ID NO: 885 - protein, 133 aa, Homo sapiens
  SIGNAL -19..-1
MDWTWRFLFVVAAATGVQSQXXLXQSGAEVKKPGSSVKVSCXASGGIXSXYSFNWVRQAPGQGFEWLGRIIPILGITNYAEKFRGRLTITVDKSTRVVYMEQSSLTSADTAVYYCAKPTMTSELRVYYQXTLW

SEQ ID NO: 886 - protein, 30 aa, Homo sapiens
  SIGNAL -22..-1
MWNRYFVFYLLLLSAFTSQTVSGQRKKGPR

SEQ ID NO: 887 - protein, 142 aa, Homo sapiens
  SIGNAL -19..-1
MKHLGFFLLLVAAPRWVLSQLQLQESGSGLEKPSQTLSLTCSVSGGSISSDDLSWSWIRQPPGKGLEWIGYIYQNERTLYNPSLKSRAAISVDRSKNQFSLKLTSVTAADMAVYYCATSVMXSFGGVLVPNLFLTTGARESR

SEQ ID NO: 888 - protein, 155 aa, Homo sapiens
  SIGNAL -19..-1
MKHLWFFLLLVAGPRWVLSQVQLXESGPRLVKPSQTLSLTCTVSGASVSSRGYYWTWIRQLPGKGLEWIGYIXYTGSTFYNPSLKSRLTISIDTSKNQFSLNLRSVTTADTAVYYCARDHFDLLFDPWGQGTLVTVSSASTKGPSVFPLAXSSKS

SEQ ID NO: 889 - protein, 63 aa, Homo sapiens
  SIGNAL -41..-1
MACRERPRPLLWRSRGRFFNWGKLFFCFVLXLFCFVFEAESRSVAQAGVQWRYFGSLQALPPW

SEQ ID NO: 890 - protein, 25 aa, Homo sapiens
  SIGNAL -21..-1
MHEFISGFFILFHWSLCLCLCQYHA

SEQ ID NO: 891 - protein, 44 aa, Homo sapiens
  SIGNAL -42..-1
MAYAISPFHSSWNPLFTSHKASASHSHLGLLVCLFAVTSILCSS

SEQ ID NO: 892 - protein, 60 aa, Homo sapiens
  SIGNAL -15..-1
MSPVLLLALLGFILPLPGSAXAXSASLGQFSMCGRCPTCPGNGPLRTPAATXXXVPGHVD

SEQ ID NO: 893 - protein, 154 aa, Homo sapiens
  SIGNAL -23..-1
MATAMDWLPWSLLLFSLMCETSAFYVPGVAPINFHQNDPVEIKAVKLTSSRTQLPYEYYSLPFCQPSKITYKAENLGEVLRGDRIVNTPFQVLMNSEKKCEVLCSQSNKPVTLTVEQSRLVAERITEDYYVHLIADNLPVATGWSSTPTETAMT

SEQ ID NO: 894 - protein, 28 aa, Homo sapiens
  SIGNAL -18..-1
MPSPCLISLLQCAHVSLGLQYPCXLLLP

SEQ ID NO: 895 - protein, 53 aa, Homo sapiens
  SIGNAL -17..-1
MNLSLVLAAFCLGIASAVPKFDQNLDTKWYQWKATHRRLYGANEEGWRRAAWE

SEQ ID NO: 896 - protein, 85 aa, Homo sapiens
  SIGNAL -19..-1
MEFGLNWVFLVAIFTGVHCEVQLVESGGDLVQPGRSLRLSCTASGFTFGDYAMTWFRQASGKRLEWLGFIRNRGSGGSAEYGASV

SEQ ID NO: 897 - protein, 51 aa, Homo sapiens
  SIGNAL -17..-1
MKNCLLILLMLLLFAIHINRMNVRNVGNTLVVVQILFSIRVFILERNPLNV

SEQ ID NO: 898 - protein, 149 aa, Homo sapiens
  SIGNAL -19..-1
MELGLSWIFLLAILKGVQCEVQLVESGGGLVQPGRSLRLSCAASGFTFDDYAMHWVRQAPGKGLEWVSGITWNSGXIGYADSVKGRFTISRDNAKNSLYLQMNSLRTEDTAFYFCAKARGLFSDTWPYXHYAMDVWGQGTTVTVSSAST

SEQ ID NO: 899 - protein, 25 aa, Homo sapiens
  SIGNAL -14..-1
MLLVFFVLWTCSLALLASSPIAAXP

SEQ ID NO: 900 - protein, 127 aa, Homo sapiens
  SIGNAL -19..-1
MDWTWRILLLVAAATDASSQMQLLQSGPEVKKTGSSVKLSCTASGDTLAYHYLHWVRQAPGQALEWMGWITPFSGDTNFAQRFQDRLTFTRDRSMSTVYMTLTSLISEDTAMYYCATDGRRTNRLFE

SEQ ID NO: 901 - protein, 68 aa, Homo sapiens
  SIGNAL -18..-1
MAGQLLGCLLWLLTHIKAQDSVRDAYWKTGSCPPPFLHVSTFXXKLTFSTKGNLLHSIPLSSPLACVL

SEQ ID NO: 902 - protein, 105 aa, Homo sapiens
  SIGNAL -91..-1
MKEAVPPGCTKSPSHFSEGFDRWALEETPPENLIGALLAIFGHLVVSIALNLQKYCHIRLAGSKDPRAYFKTKTWWLGLFLMLLGELGVFASYAFAPLSLIVPLS

SEQ ID NO: 903 - protein, 44 aa, Homo sapiens
  SIGNAL -18..-1
MAFLWLLSCWALLGTTFGCGVPAIHPGCQLSPRLPPTLLPTERG

SEQ ID NO: 904 - protein, 82 aa, Homo sapiens
  SIGNAL -20..-1
MAPFQNFLWLFFVLNLGSFAFSSXPNSLFYTIHFGPNFFTLLYKQGAEMCVYVFNFLYPFALGYFFSYDILDLPVXVRPPSG

SEQ ID NO: 905 - protein, 54 aa, Homo sapiens
  SIGNAL -35..-1
MDFTQCHSLLLRVEYSPVSVCFLLLSVAFNQLVFALYPIQATXCFSXVSLPFPA

SEQ ID NO: 906 - protein, 23 aa, Homo sapiens
  SIGNAL -15..-1
MLLLLLACGVPSLWPFALALLKT

SEQ ID NO: 907 - protein, 43 aa, Homo sapiens
  SIGNAL -23..-1
MFIENIGLKFSFLLLHLCQVLLSRRAGTIPTETIPKKLRRRDG

SEQ ID NO: 908 - protein, 105 aa, Homo sapiens
  SIGNAL -24..-1
MQNRTGLILCAXALLMGFLMVCLGAFFISWGSIFDCQGSLIAAYLLLPLGFVILLSGIFWSNYRQVTESKGVLRHMLRQHLAHGALPVATVDSAALLKIMCKQLL

SEQ ID NO: 909 - protein, 52 aa, Homo sapiens
  SIGNAL -44..-1
MKVEGEEKLYRLLRSGDLFKFHQPHFYELSGLTCTSSLLSFALGRSIPGSFP

SEQ ID NO: 910 - protein, 60 aa, Homo sapiens
  SIGNAL -19..-1
MESRTLLLLFSGAVALIQTWAGECGVGREKASAGRSEGPARRSKSAHIXNYRLQLQSRQG

SEQ ID NO: 911 - protein, 35 aa, Homo sapiens
  SIGNAL -16..-1
MSNSVPLLCFWSLCYCFAAGSPVPFGPEGRLEDKL

SEQ ID NO: 912 - protein, 52 aa, Homo sapiens
  SIGNAL -14..-1
MPWTILLFAAGSLAIPAPSIRVVPPYPSSQEDPIHIACMAAGNFPGANFTLY

SEQ ID NO: 913 - protein, 67 aa, Homo sapiens [sequence omitted]

SEQ ID NO: 914 - protein, 71 aa, Homo sapiens
  SIGNAL -13..-1
MFCLAAILASASAQRFPSAFSPSPFXWLXQCXTATSLGFXTVCXNSIISLWYLXGVPPEVXELPFFPYCSM

SEQ ID NO: 915 - protein, 93 aa, Homo sapiens
  SIGNAL -17..-1
MVDGTLLLLLSEALALTQTWAGSHSXKYFHTSVSRXGRGEPRFISVGYVDDTRSEYWDRETRSARDTAQIFRVNLRTLRGYYNQSEAGSXTLQ

SEQ ID NO: 916 - protein, 75 aa, Homo sapiens
  SIGNAL -27..-1
MNFRGPQTFSLSHSLVLSLISLSIAWSMVEMXTSASYKQKFALRILVVQLPTWVECPVNHRCALGRKNCSIRTQP

SEQ ID NO: 917 - protein, 25 aa, Homo sapiens [sequence omitted]

SEQ ID NO: 918 - protein, 98 aa, Homo sapiens
  SIGNAL -26..-1
MDLLCKNMKHLWFFLLLVAAPRWVQLQESGPRLVRPPETLKPSETLSLTCTISGDSMSSASYYWAWIRQPPGKGLEFIGRALYSGTTDYNPSLSSRIT

SEQ ID NO: 919 - protein, 52 aa, Homo sapiens
  SIGNAL -45..-1
MSSEKSGLPDSVPHTSPPPYNAPQPPAEPPAPPLSLSLCLSLCHTHTHTHTH

SEQ ID NO: 920 - protein, 46 aa, Homo sapiens
  SIGNAL -28..-1
MTPALRCAFALAIAGLVSLLMQPEGALGEEAASAAAQGRQLAELRL

SEQ ID NO: 921 - protein, 70 aa, Homo sapiens
  SIGNAL -38..-1
MSGLFPVPVRVNVDIAQNITCSSFSLLLIFLSFPYTLCILYRVKSYTPTESITAFNLTIGXFPYLXXSTP

SEQ ID NO: 922 - protein, 39 aa, Homo sapiens [sequence omitted]

SEQ ID NO: 923 - protein, 59 aa, Homo sapiens
  SIGNAL -17..-1
MKFLLLXALGFLXQVNPXPIXGGSKMCEXHPRILQDMLPLGGDSIVHVQRXQKMLHQLL

SEQ ID NO: 924 - protein, 105 aa, Homo sapiens
  SIGNAL -42..-1
MVPWVRTMGQKLKQRLRLDVGREICRQYPLFCFLLLCLSAASLLLNRYIHILMIFWSFVAGVVTFYCSLGPDSLLPNIFFTIKYKPKQLGLQELFPQGHSCAVCG

SEQ ID NO: 925 - protein, 43 aa, Homo sapiens
  SIGNAL -34..-1
MAWGSPGKIFLMGFLGGELVFLLCLFXLFFFSFLKRSFALECN

SEQ ID NO: 926 - protein, 28 aa, Homo sapiens
  SIGNAL -16..-1
MFFSILLLLAPPLPSAVSLLPFFFYCVQ

SEQ ID NO: 927 - protein, 42 aa, Homo sapiens
  SIGNAL -22..-1
MVDFILRSLLLVCSWLSISLHAHTTAFCTYSKKIHTVMSFFC

SEQ ID NO: 928 - protein, 26 aa, Homo sapiens
  SIGNAL -16..-1
MRSLLYFLCVSSYVTSFFFFFFFFFF

SEQ ID NO: 929 - protein, 68 aa, Homo sapiens
  SIGNAL -15..-1
MPFISFLCLIALAGTSSTMLRSALAGTSSTMXXRSGXSGXPXLVXVLRGNAFSFFPFSLMXAMGCHRW

SEQ ID NO: 930 - protein, 22 aa, Homo sapiens
  SIGNAL -16..-1
MYTFLLGAIFIALSSSRILLVK

SEQ ID NO: 931 - protein, 44 aa, Homo sapiens
  SIGNAL -42..-1
MCLCPCWDVFTVFVCVSVCVSVSVPVGMYLVCVCVCVCVCXCXR

SEQ ID NO: 932 - protein, 50 aa, Homo sapiens
  SIGNAL -34..-1
MLIAKQAQPQGLTAICFPLTPLFSLLMLTQSPLAGQEGREGGKERYLLVI

SEQ ID NO: 933 - protein, 62 aa, Homo sapiens
  SIGNAL -26..-1
MLRTWSSLPWTRFRVCLLSLSLFLWANRLEDSRSCQPNPMSLTTLPGHRLKEAVWLPAPSLG

SEQ ID NO: 934 - protein, 72 aa, Homo sapiens
  SIGNAL -29..-1
MAPFLRQVDXWGAQAGLVVXWLLPXQCSCERSEQYLSTCLPQHSSIKQSCIKHPAGPIPAGHLQGKATAAPL

SEQ ID NO: 935 - protein, 73 aa, Homo sapiens
  SIGNAL -19..-1
MEFGLKWLFLVAILKGVRCEVKLVESGGGLVQPGGSLRLSCVGSGFVFDKYGISWVRQAPGKGLQWVAGIGGG

SEQ ID NO: 936 - protein, 128 aa, Homo sapiens
  SIGNAL -16..-1
MALAMLVLVVSPWSAARGVLRNYWERLLRKLPQSRPGFPSPPWGPALAVQGPAMFTEPANDTSGSKENSSLLDSIFWMAAPKNRRTIEVNRCRRRNPQKLIKVKNNIDVCPECGHLKQKXVLCATAMK

SEQ ID NO: 937 - protein, 30 aa, Homo sapiens
  SIGNAL -20..-1
MFFYSHFLLLFPLSLLFTLGFLFVFFFFFF

SEQ ID NO: 938 - protein, 101 aa, Homo sapiens
  SIGNAL -46..-1
MKQSKRXMVKRRRSPALGEERFSPSSILHPRLPLVLLGTRVPLSGGGPGEPDQGRSAPSWKSLASTHXHSRPAAGATPARPATQSQLGPFAPPLPGVRPAP

SEQ ID NO: 939 - protein, 32 aa, Homo sapiens [sequence omitted]

SEQ ID NO: 940 - protein, 94 aa, Homo sapiens
  SIGNAL -46..-1
MVFGYWKQPLITLAKKSVKCARECLRCSLRPLVLLYLSFAALGVVALRSVESPLAETHSCWLSLGMCVLQCEQQWVPTPVSFLCGLSGSSTIIV

SEQ ID NO: 941 - protein, 66 aa, Homo sapiens
  SIGNAL -24..-1
MCVVCSVHGVCCVYVVCLVSCVLCVVCPVCWVMCCVWCICVCVWCVCCMCCVLSCVVSHGLCGVSW

SEQ ID NO: 942 - protein, 59 aa, Homo sapiens
  SIGNAL -19..-1
MELGLSWVFLVAVLEVVQCEIQLIDAGGGHVQAGGSLRLSCVASDFLFRSYWMTWVRHP

SEQ ID NO: 943 - protein, 41 aa, Homo sapiens [sequence omitted]

SEQ ID NO: 944 - protein, 27 aa, Homo sapiens
  SIGNAL -25..-1
MAEKAGSTFSHLLVPILLLIGWIVGCT

SEQ ID NO: 945 - protein, 34 aa, Homo sapiens
  SIGNAL -19..-1
MAESRGRLYLWMCLAAALASFLMGFMVGWFIKPL

SEQ ID NO: 946 - protein, 40 aa, Homo sapiens
  SIGNAL -26..-1
MLTSLPFLLPTISFLLLLYFFXIAVTHPSVLINFSFSFPR

SEQ ID NO: 947 - protein, 36 aa, Homo sapiens
  SIGNAL -20..-1
MRKDVRFLLFFTCGLPALHGDSRVECSKAHPPAMYY

SEQ ID NO: 948 - protein, 48 aa, Homo sapiens [sequence omitted]

SEQ ID NO: 949 - protein, 65 aa, Homo sapiens
  SIGNAL -47..-1
MPVCFYSLICFFIYFCLLSPRETIEEVALFQFSLLXLGEGLTFLCLCQVMTNXMQLLFLSGVVCG

SEQ ID NO: 950 - protein, 21 aa, Homo sapiens
  SIGNAL -13..-1
MAPLLLSLSCSFSCHVTLLPR

SEQ ID NO: 951 - protein, 47 aa, Homo sapiens
  SIGNAL -20..-1
MVPAAGALLWVLLLNLGPRAAGAQGLTQTPTEMQRVSLRFGGPMTRR

SEQ ID NO: 952 - protein, 58 aa, Homo sapiens [sequence omitted]

SEQ ID NO: 953 - protein, 74 aa, Homo sapiens
  SIGNAL -51..-1
MFFLNIAMFIVVMVQICGRNGKRSNRTLREEVLRNLRSVVSLTFLLGMTWGFAFFAWGPLNIPFMYLFSIFNSL

SEQ ID NO: 954 - protein, 58 aa, Homo sapiens
  SIGNAL -17..-1
MNKHFLFLFLLXXLIVAVTSLQCITCHLRTRTDRCRRGFGXCTAQKGEACMLLRIHQR

SEQ ID NO: 955 - protein, 47 aa, Homo sapiens [sequence omitted]

SEQ ID NO: 956 - protein, 40 aa, Homo sapiens
  SIGNAL -27..-1
MXXALLRSRMIQGRILLLTICAAGIXGTRQFGYNLSIIND

SEQ ID NO: 957 - protein, 54 aa, Homo sapiens
  SIGNAL -47..-1
MMGXLCPRSLPIPPMILSWWKMQWKPLALENFSGSCLFSXAWLXCXCHGDDDLS

SEQ ID NO: 958 - protein, 48 aa, Homo sapiens
  SIGNAL -15..-1
MGLLQLLAFSFLGNSVETVRGGGRTWAWGRKTQKLLAHLRGILGAWXR

SEQ ID NO: 959 - protein, 25 aa, Homo sapiens
  SIGNAL -14..-1
MLVLVHSSLSKTLSQKKKKFTXPTR

SEQ ID NO: 960 - protein, 48 aa, Homo sapiens [sequence omitted]

SEQ ID NO: 961 - protein, 28 aa, Homo sapiens
  SIGNAL -22..-1
MGFWCGCPFCLXVFLLTDRTLSCRSVGV

SEQ ID NO: 962 - protein, 27 aa, Homo sapiens [sequence omitted]

SEQ ID NO: 963 - protein, 28 aa, Homo sapiens
  SIGNAL -25..-1
MASLLSGFTSFCLLHVHSFLPPVFSTQN

SEQ ID NO: 964 - protein, 42 aa, Homo sapiens
  SIGNAL -30..-1
METALXXTPQKRQVMFLAILLXXWEAGSEAVRYSIPEETESG

SEQ ID NO: 965 - protein, 66 aa, Homo sapiens
  SIGNAL -35..-1
MMLDFALSPRLERSGLIMACCTLDLLGSSSPPTSASQVAGTGHVPPHPASFFYFXVXQVYYVSQLI

SEQ ID NO: 966 - protein, 64 aa, Homo sapiens
  SIGNAL -22..-1
MRTPQLALLQVFFLVFPDGVRPQPSSSPSGAVPTSLELQRGTDGGTLQSPSEATATRPAVPGLR

SEQ ID NO: 967 - protein, 46 aa, Homo sapiens [sequence omitted]

SEQ ID NO: 968 - protein, 23 aa, Homo sapiens [sequence omitted]

SEQ ID NO: 969 - protein, 27 aa, Homo sapiens
  SIGNAL -18..-1
MVFLVXLLCIIXLYLIRGSEWXLPPNW

SEQ ID NO: 970 - protein, 53 aa, Homo sapiens [sequence omitted]

SEQ ID NO: 971 - protein, 37 aa, Homo sapiens
  SIGNAL -29..-1
MSIRSNWSSVESKSRISLLVFCLNDLSNAVXXGIEXP

SEQ ID NO: 972 - protein, 120 aa, Homo sapiens
  SIGNAL -16..-1
MAWIPLFLGVLAYCTGSVASYELTHPPSVSVSPGQTASITCSGDKLGDKYACWYQQKPGQSPVLVIYQDSKRPSGIPERFSGSNSGNTATLTISGTQAMDEADYYCQAWDSSTVVFGGGT

SEQ ID NO: 973 - protein, 32 aa, Homo sapiens
  SIGNAL -29..-1
MVCVIFKELMEFEFPGFCFXLCFGRSSLCCRX

SEQ ID NO: 974 - protein, 78 aa, Homo sapiens
  SIGNAL -30..-1
MESSGTPSVTLIVGSGLSCLALXTLAVVYAALWRYIRSERSIILINFCLSIISSNILILVGQTQTHNKEYLHNHHCIF

SEQ ID NO: 975 - protein, 58 aa, Homo sapiens
  SIGNAL -31..-1
MGVCCAQNCSVSGXXRNALXFLASSFCFGEADSGSRCCLKIILGFYLIRYSLITYQVR

SEQ ID NO: 976 - protein, 40 aa, Homo sapiens
  SIGNAL -18..-1
MKILYLFFFLKWSHPGWSATXWSWHTATSASLIQVILPPW

SEQ ID NO: 977 - protein, 34 aa, Homo sapiens
  SIGNAL -26..-1
MTPCFLQMDNLTPLFLSGCFLFLSXCXIYLARIL

SEQ ID NO: 978 - protein, 48 aa, Homo sapiens
  SIGNAL -40..-1
MGSAGRLHYLXMTAENPTPGDLAPXPLITCKLCLCEQSXGQDDHTPGM

SEQ ID NO: 979 - protein, 88 aa, Homo sapiens
  SIGNAL -49..-1
MNHLPPNHYRXHVFTCHVDQYLTVETAGGMEKEAVSVTVLLSAAPCLLSCFLGSSVSGLAFWVSQQKTKGPERCKNTHHXAXNNFPAR

SEQ ID NO: 980 - protein, 42 aa, Homo sapiens
  SIGNAL -40..-1
MNKIKENTHTHTHTHTHKNNTKLVSNLFLFMLPLWCSIGTCT

SEQ ID NO: 981 - protein, 51 aa, Homo sapiens [sequence omitted]

SEQ ID NO: 982 - protein, 37 aa, Homo sapiens
  SIGNAL -33..-1
MGRLHRPRSSTSYRNLPHLFLFFLFVGPFSCLGSYSR

SEQ ID NO: 983 - protein, 44 aa, Homo sapiens
  SIGNAL -27..-1
MQSQAAREHKPGXSRLLLLLLLXLPLPPPXLRTRXFSXTTLTAG

SEQ ID NO: 984 - protein, 25 aa, Homo sapiens
  SIGNAL -15..-1
MRLWSLACLSPPAVQLGSQQATDWW

SEQ ID NO: 985 - protein, 32 aa, Homo sapiens
  SIGNAL -25..-1
MSPLFILIVLIWIFSFFFFITLVRGSINLFFF

SEQ ID NO: 986 - protein, 25 aa, Homo sapiens
  SIGNAL -22..-1
MNLGGHSDHSTFLFFLFFSVFCFFF

SEQ ID NO: 987 - protein, 91 aa, Homo sapiens
  SIGNAL -21..-1
MLDFAIFAVTFLLALVGAVLYLYPASRQAAGIPGITPTEEKDGNLPDIVNSGSLHEXLVNLHERYGPVVSFWFGRRLVVSLGTVDVLKQHR

SEQ ID NO: 988 - protein, 28 aa, Homo sapiens
  SIGNAL -18..-1
MAHCSLELLGSSSPPISASQSTGITSVS

SEQ ID NO: 989 - protein, 44 aa, Homo sapiens [sequence omitted]

SEQ ID NO: 990 - protein, 83 aa, Homo sapiens
  SIGNAL -46..-1
MYTNKYTLIYNILIYNICXXYMWLILIYMYLHICLFCCXFISSCNSVFPCVIXFLLPEELLXVXLXXXFXVRWSLXXSSRLEC

SEQ ID NO: 991 - protein, 35 aa, Homo sapiens
  SIGNAL -31..-1
MLLTHNEDYMPGNXXXXXLWSLIQAVHICLGRKKK

SEQ ID NO: 992 - protein, 89 aa, Homo sapiens
  SIGNAL -19..-1
MEFGLSWVFLVAIIKGVQCQVQLVESGGGLVKPGGSLRLSCAASGFTFSDYXXTXIRXAXGKGLXWIXXITTSGNTAXYAXSVKXRFTI

SEQ ID NO: 993 - protein, 55 aa, Homo sapiens
  SIGNAL -17..-1
MKRFFLFVCLXFDESCSVTRLGCCGAISAHCXLRLPGSSXXPASTSRVXGITGMR

SEQ ID NO: 994 - protein, 40 aa, Homo sapiens [sequence omitted]

SEQ ID NO: 995 - protein, 50 aa, Homo sapiens
  SIGNAL -26..-1
MTSSVHLLVFKDHLLSMLSCCQGACCPSTPHEGTRSTVSWIPPTYKAATQ

SEQ ID NO: 996 - protein, 23 aa, Homo sapiens
  SIGNAL -19..-1
MVRASILLSMFCVSHTVQTATYT

SEQ ID NO: 997 - protein, 52 aa, Homo sapiens [sequence omitted]

SEQ ID NO: 998 - protein, 50 aa, Homo sapiens
  SIGNAL -23..-1
MIFTFQQIGGKLLLSGLTQECLGALPEANVFCRGGCTATVLKHGKASPES

SEQ ID NO: 999 - protein, 46 aa, Homo sapiens
  SIGNAL -31..-1
MNCVRQANIRMQCKIYDSLLALSPDLQAARGLMCAASVMSFLAFMM

SEQ ID NO: 1000 - protein, 44 aa, Homo sapiens
  SIGNAL -40..-1
MIWLSFCLLLVYRNACDFCTLTLYPGTLLKLLISLRSFWAETTG

SEQ ID NO: 1001 - protein, 43 aa, Homo sapiens
  SIGNAL -25..-1
MFSSPGLRTLFVLVGSLHLFLSVLASKSRNSKKQRLFLLVPLY

SEQ ID NO: 1002 - protein, 51 aa, Homo sapiens
  SIGNAL -23..-1
MLTDGILMRVNVCSLPAPGLCSGQPGVRAWPGVTQLTQXEECPWFSALEGL

SEQ ID NO: 1003 - protein, 49 aa, Homo sapiens
  SIGNAL -33..-1
MFNWNPWLTTLITGXAGPLLILLLSLIFGPCILNSFLNXIKQRIASGKR

SEQ ID NO: 1004 - protein, 102 aa, Homo sapiens
  SIGNAL -29..-1
MAGSRQRGLRARVRPLFCALLLSLXXXXPXXRRXRRPRGRVATSPFRVXIQLQGAAPGAERRDRALLGPRGECYSKFRSNSSSTIFKKXKRLSVXXDXSGPG

SEQ ID NO: 1005 - protein, 96 aa, Homo sapiens
  SIGNAL -19..-1
MEFGLSWVFLVAILKGVHCDVQLVESGGGLVQPGGSLRLSCAASGLTLSNDWMHWVRQAPGKGLVWVSHIDSSXTITNYADSVKGRFTISRDNAKW

SEQ ID NO: 1006 - protein, 38 aa, Homo sapiens [sequence omitted]

SEQ ID NO: 1007 - protein, 104 aa, Homo sapiens
  SIGNAL -49..-1
MWEDSRNKRGGRWLVSLAKQQRHIELDRLWLETFSVFLGLIFFLELATGILAFVFKDWIRDQLNLFINNNVKAYRDDIDLQXLIDFAQEYWSCCGXEAPIXGTG

SEQ ID NO: 1008 - protein, 34 aa, Homo sapiens
  SIGNAL -14..-1
MFLSLSTAFWVVYAMIIYSALSAGFIIFFLVVFN

SEQ ID NO: 1009 - protein, 38 aa, Homo sapiens [sequence omitted]

SEQ ID NO: 1010 - protein, 54 aa, Homo sapiens
  SIGNAL -27..-1
MVAHDYQNIISLFFLAFSFSFFPSSFSSFFLXFLSFFSSFFLSLLSFPSFLPPG

SEQ ID NO: 1011 - protein, 136 aa, Homo sapiens
  SIGNAL -15..-1
MAALRALCGFRGVAAQVLRXGAGVRLPIQPSRGVRQWQPDVEWAQQFGGAVMYPSKETAHWKPPPWNDVDPPKDTIVKNITLNFGPQHPAAHGVLRLVMELSGEMVRKCDPHIGLLHRGTEKLIEYKXYLQALPYF

SEQ ID NO: 1012 - protein, 50 aa, Homo sapiens
  SIGNAL -28..-1
MLIWSSSSFPAPPLFLVFLHLFLXVYLGLVMPTQQYLLLQSPLMFTDKAQ

SEQ ID NO: 1013 - protein, 57 aa, Homo sapiens [sequence omitted]

SEQ ID NO: 1014 - protein, 40 aa, Homo sapiens
  SIGNAL -31..-1
MXTQEAGLIFFSPPFSLSLSLSLPLSLXLLXXPHSRTPQR

SEQ ID NO: 1015 - protein, 43 aa, Homo sapiens
  SIGNAL -13..-1
MEFLLLWSLXSNGKRGQAWRLMPVVPAVWEPEAGGLLQLGGSR

SEQ ID NO: 1016 - protein, 88 aa, Homo sapiens
  SIGNAL -37..-1
MMVTYRWGFGVDVXFVAVDAIPFCLLVFFLIVRTLSCRSVGVCWRSTPDPVCLGITSRGCRTEILQNSKCCSLILPLEASSQRGTECM

SEQ ID NO: 1017 - protein, 34 aa, Homo sapiens [sequence omitted]

SEQ ID NO: 1018 - protein, 48 aa, Homo sapiens
  SIGNAL -27..-1
MSLEPASXLLGVRRRLLCLXFXRLLLGTSLLKFVXSXSPPXPXTLTSS

SEQ ID NO: 1019 - protein, 33 aa, Homo sapiens
  SIGNAL -24..-1
MLILYLATLLNLSVLILCVCVCVCVYDLYIXRG

SEQ ID NO: 1020 - protein, 117 aa, Homo sapiens
  SIGNAL -16..-1
MAPLGTTVLLWSLLRSSPGVERVCFRARIQPWHGGLLQPLPCSFEMGLPRRRFSSEAAESGSPETKKPTFMDEEVQSILTKMTGLNLQKTFKPAIQELKPPTYKLMXQAQLEEATRQ

SEQ ID NO: 1021 - protein, 99 aa, Homo sapiens
  SIGNAL -34..-1
MLLTFSSSSRHRRLYRRRRHHLLFVVLLPPPPGSVXLCSXXXXXVLXXXKFRXGLHGAMLPGLFRGRPRAALRLRVSPXCPGWKVARSRLTATSASRXR

SEQ ID NO: 1022 - protein, 32 aa, Homo sapiens [sequence omitted]

SEQ ID NO: 1023 - protein, 18 aa, Homo sapiens
  SIGNAL -15..-1
MSLFVLLIITQLLYGGIL

SEQ ID NO: 1024 - protein, 34 aa, Homo sapiens [sequence omitted]

SEQ ID NO: 1025 - protein, 33 aa, Homo sapiens
  SIGNAL -14..-1
MSVILALWEAEAGGSPEIGSSGPAAPTWRSPVQ

SEQ ID NO: 1026 - protein, 61 aa, Homo sapiens
  SIGNAL -29..-1
MYGESTLFIHSSVHGHLGCLLLAVRSSATVNITYXXVCVDIXXHFHMLMSGITGSYGNSLS

SEQ ID NO: 1027 - protein, 74 aa, Homo sapiens [sequence omitted]

SEQ ID NO: 1028 - protein, 84 aa, Homo sapiens
  SIGNAL -65..-1
MLRSACVSQHAGGIWVDRGGPQCQRVFTFCRGLSPNFGRSETQRERWIRPGQLMVVAETSQGSWSAPTSPXTSCPPPNTXTTPX

SEQ ID NO: 1029 - protein, 94 aa, Homo sapiens
  SIGNAL -45..-1
MVSRSLRGRRTWVRCMRRLPPIPAWSQGKGMPGFVSLLVVHAADAWVAQRLSTPYFSLFLSIPRCSFPRRSIDRTCSSXLDSEGSSSIXPSTPF

SEQ ID NO: 1030 - protein, 38 aa, Homo sapiens
  SIGNAL -21..-1
MVGALPPASLLPCSLISDCCASNERGSMGVGPSEPRRG

SEQ ID NO: 1031 - protein, 22 aa, Homo sapiens
  SIGNAL -20..-1
MRMTKDPLGSLIASLAPSTGLG

SEQ ID NO: 1032 - protein, 57 aa, Homo sapiens
  SIGNAL -28..-1
MKLQFAFCYFLYLDTFFLFLFFXEXXXXXXXGRSAVAXPQLXAASTFXFQAIFLPQX

SEQ ID NO: 1033 - protein, 84 aa, Homo sapiens
  SIGNAL -69..-1
MAAGELEGGKPLSGLLNALAQDTFHGYPGITEELLRSQLYPEVPPEEFHPFLAKMRGILKVLLFSVVSGLEQNPLAAGFRLSHP

SEQ ID NO: 1034 - protein, 47 aa, Homo sapiens
  SIGNAL -31..-1
MMMSNVMLMLQLQPLLAXSLILSPSPRPVLGFFRQVHLLTRSHFSRW

SEQ ID NO: 1035 - protein, 37 aa, Homo sapiens
  SIGNAL -20..-1
MIILINQLLFICPPPPPISASSNYHFTLYLHDINFFS

SEQ ID NO: 1036 - protein, 18 aa, Homo sapiens
  SIGNAL -15..-1
MTDVLLQLLLRVCSPRTR

SEQ ID NO: 1037 - protein, 25 aa, Homo sapiens
  SIGNAL -13..-1
MGLFLCCSLLIFCLVVLIITELGYG

SEQ ID NO: 1038 - protein, 30 aa, Homo sapiens
  SIGNAL -14..-1
MGSWALTWLHPAEAGTRVPFCSWEKSDGRS

SEQ ID NO: 1039 - protein, 65 aa, Homo sapiens
  SIGNAL -42..-1
MMLXXXRGYPHRTERYDGFLKYSDPNDIALSVLSLVINFSWSRKCFVPYYIPFKPYRXPYPTAAR

SEQ ID NO: 1040 - protein, 51 aa, Homo sapiens
  SIGNAL -39..-1
MYVCIYIXLXDLYDFFLLGTYFFERKCFVCXLFVFLLSGLNYFSILSFYPR

SEQ ID NO: 1041 - protein, 50 aa, Homo sapiens [sequence omitted]

SEQ ID NO: 1042 - protein, 40 aa, Homo sapiens
  SIGNAL -27..-1
MXICYNIFQNILGLLLIFLYLSLNLFCIFFSVPALQPRRL

SEQ ID NO: 1043 - protein, 29 aa, Homo sapiens
  SIGNAL -26..-1
MASSMLXSFQTFMMLTLLGFPSKALTFIS

SEQ ID NO: 1044 - protein, 33 aa, Homo sapiens
  SIGNAL -20..-1
MGRSKRQLLSLPGSFIPGNCRPRILSNGEXRRK

SEQ ID NO: 1045 - protein, 48 aa, Homo sapiens
  SIGNAL -25..-1
MRSDGFIRGFCFCFFLIFLLPPLPAMILRPLQPCGIISPIKPLFPFFF

SEQ ID NO: 1046 - protein, 39 aa, Homo sapiens
  SIGNAL -16..-1
MNTLWTASSLPLSTHSQRTMIHWNVFLWNSFYSCIKIFP

SEQ ID NO: 1047 - protein, 46 aa, Homo sapiens
  SIGNAL -31..-1
MTWTKCPLPLGPAFFTQCCLIGLLVPLLGWGNQNTQWYPTSKMPDG

SEQ ID NO: 1048 - protein, 37 aa, Homo sapiens [sequence omitted]

SEQ ID NO: 1049 - protein, 24 aa, Homo sapiens
  SIGNAL -18..-1
MKTDNLTSFLTYMPLISSSCSIAP

SEQ ID NO: 1050 - protein, 130 aa, Homo sapiens
  SIGNAL -79..-1
MRFRFCGDLDCPDWVLAEISTLAKMSSVKLRLLCSQVLKELLGQGIDYEKILKLTADAKFESGDVKATVAVLSFILSSAAKHSVDGESLSSELQQLGLPKEHAASLCRCYEEKQSPLQKHLRVCSLRMNR

SEQ ID NO: 1051 - protein, 79 aa, Homo sapiens
  SIGNAL -14..-1
MFLAALFTVAKIWKQPKCSSTNKWTKKMWYIYTMEYYSAIKKDDILSFATIWMELESITLSEISGXPKDKLLMFSLICG

SEQ ID NO: 1052 - protein, 30 aa, Homo sapiens
  SIGNAL -27..-1
MESSTFALVPVFAHLSILQSLVPAAGAXSP

SEQ ID NO: 1053 - protein, 84 aa, Homo sapiens
  SIGNAL -78..-1
MGCLLASEYPLSEPWAPGPFTQYLVDHHHTLLCNGYWLAWLIHVGESLYAIVLCKHKGITSGRAQLLWFLQTFFFGIASLXILI

SEQ ID NO: 1054 - protein, 32 aa, Homo sapiens
  SIGNAL -16..-1
MCCWIWVASILLRIFASVLIRDIYLWFSFFFF

SEQ ID NO: 1055 - protein, 37 aa, Homo sapiens
  SIGNAL -23..-1
MISSHLYNFSLLFFXLWLRYKESGREGNCEEGAFSRW

SEQ ID NO: 1056 - protein, 122 aa, Homo sapiens
  SIGNAL -17..-1
MGWQRLLLLPRPPASTGASNATRXPKXLYRXYNHGVLKITICKSCQKPVDKYIEYDPVIILXNAILCKAXAYRHILFNTQINNKLPILLAFLPSCGXTAHDGKKKPNFILLLKXYYYLATEN

SEQ ID NO: 1057 - protein, 41 aa, Homo sapiens
  SIGNAL -19..-1
MAAGVSLLALVVRVILSTAILCPSGASRRQRSSEVEWGTDS

SEQ ID NO: 1058 - protein, 19 aa, Homo sapiens
  SIGNAL -15..-1
MNPLFWLILCSGLLCNKSF

SEQ ID NO: 1059 - protein, 20 aa, Homo sapiens
  SIGNAL -18..-1
MRGAWISIFLSSLSLSLSLF

SEQ ID NO: 1060 - protein, 32 aa, Homo sapiens [sequence omitted]

SEQ ID NO: 1061 - protein, 52 aa, Homo sapiens
  SIGNAL -33..-1
MYLYLLSICMSSLKKCLFKFLAHFLIGLTVCFGEGXLMSYRSSYLLLKGPPG

SEQ ID NO: 1062 - protein, 27 aa, Homo sapiens
  SIGNAL -22..-1
MGFWCECPFCLLVFLLTEWTSSKLQKT

SEQ ID NO: 1063 - protein, 24 aa, Homo sapiens
  SIGNAL -22..-1
MWWGRCFIRVLHLFPLTPASTGHW

SEQ ID NO: 1064 - protein, 58 aa, Homo sapiens [sequence omitted]

SEQ ID NO: 1065 - protein, 28 aa, Homo sapiens
  SIGNAL -17..-1
MSSAWLCLPCSLCVSQLLPSYSLLIPAP

SEQ ID NO: 1066 - protein, 27 aa, Homo sapiens
  SIGNAL -21..-1
MSPMWAGLLSLLGPLXPPMRACSVCVL

SEQ ID NO: 1067 - protein, 39 aa, Homo sapiens
  SIGNAL -18..-1
MSLNELSIADLLPSSSFANPKLSGPISISVTSAGSPPGA

SEQ ID NO: 1068 - protein, 26 aa, Homo sapiens [sequence omitted]

SEQ ID NO: 1069 - protein, 29 aa, Homo sapiens
  SIGNAL -19..-1
MANDIKHLFMCLLTICISSLEKLPFFFFF

SEQ ID NO: 1070 - protein, 98 aa, Homo sapiens
  SIGNAL -24..-1
MYQKVTSYCRSATLVGFTVGSVLGQILVSVAGWSLFSLNVISLTCVSVAFAVAWFLPMPQKSLFFHHIPSTCQRVNGIKVQNGGIVTDTQLLTPSWLG

SEQ ID NO: 1071 - protein, 19 aa, Homo sapiens
  SIGNAL -17..-1
MMPPALFFLLRIAWLLGLF

SEQ ID NO: 1072 - protein, 38 aa, Homo sapiens
  SIGNAL -21..-1
MNCVTLIQALSLWASVSPSWMCRPPASFIITTTTTTCG

SEQ ID NO: 1073 - protein, 19 aa, Homo sapiens [sequence omitted]

SEQ ID NO: 1074 - protein, 255 aa, Homo sapiens
  SIGNAL -34..-1
MVGEAGRDLRRRRAVAVTAEKMAVLAPLIALVYSVPRLSRWLAQPYYLLSALLSAAFLLVRKLPPLCHGLPTQREDGNPCDFDWREVEILMFLSAIVMMKNRRSITVEQHIGNIFMFSKVANTILFFRLDIRMGLLYITLCIVFLMTCKPPLYMGPEYIXYFNDKTIDEELERDKRVTWIVEFFAXWSNDCQSFAPIYADLSLKYNCTGLNFGKVDVGRYTDVSTRYKVSTSPLTKQLPTLILFQGGKEAMRRPQ

SEQ ID NO: 1075 - protein, 153 aa, Homo sapiens
  SIGNAL -17..-1
MTMYLWLKLLAFGFAFLDTEVFVTGQSPTPSPTGLTTAKMPSVPLSSDPLPTHTTAFSPASTFERENDFSETTTSLSPDNTSTQVSPDSLDNASAFXTTGVSSVQTPXLPTHADSQTPSAGTDTQTFSGSAXMQNSTLPQAAMLSQMSQERGV

SEQ ID NO: 1076 - protein, 42 aa, Homo sapiens
  SIGNAL -17..-1
MTMYLWLKLLAFGFAFLDTEVFVTGQSPTPSPTGVSSVQTPQ

SEQ ID NO: 1077 - protein, 87 aa, Homo sapiens
  SIGNAL -17..-1
MTMYLWLKLLAFGFAFLDTEVFVTGQSPTPSPTGVSSVQTPHLPTHADSQTPSAGTDTQTFSGSAXMQNSTLPQAAMLSQMSQERGV

SEQ ID NO: 1078 - protein, 42 aa, Homo sapiens [sequence omitted]

SEQ ID NO: 1079 - protein, 72 aa, Homo sapiens
  SIGNAL -64..-1
MGVLPDLVVEIFGVNKCRLSWGLVLESLQQPLINRHLIYCLGDIILXXLDLSALLRSLLLPXLXQIPQATLR

SEQ ID NO: 1080 - protein, 42 aa, Homo sapiens
  SIGNAL -15..-1
MTALGFVLLAPRGWGSLTVMVEGKEEQVTSYTDGSRQRDSNF

SEQ ID NO: 1081 - protein, 64 aa, Homo sapiens
  SIGNAL -39..-1
MKRIRRKRRNEVTIQPFPIRLPLLPPLISFLHTLQVVCSVIMKSIRKAFVLCGFLYFEFFDQKL

SEQ ID NO: 1082 - protein, 59 aa, Homo sapiens
  SIGNAL -22..-1
MLPLLHCFFXVXLFXXVXVXXAALLRYNXSIQXGRAQXLXPXIPXLWETKXGRLLEPRN

SEQ ID NO: 1083 - protein, 30 aa, Homo sapiens
  SIGNAL -21..-1
MVSVFRSEEMCLSQLFLQVEAAYCCVAELG

SEQ ID NO: 1084 - protein, 41 aa, Homo sapiens
  SIGNAL -28..-1
MAALRSTLTWTEVVGWWSVASLLSDVAAWWPPHSTSTRGGV

SEQ ID NO: 1085 - protein, 47 aa, Homo sapiens
  SIGNAL -44..-1
MNALVDGKRLXXCIRYFDSISLYSKASLSCCLVCVFTCSLLAFFSPC

SEQ ID NO: 1086 - protein, 84 aa, Homo sapiens
  SIGNAL -19..-1
MEFGLSWVFLVAILKGVQCELQVVESGGGLVQPGRSLRLSCRTSGFAFDDYNLSWVRQAPGKGLEWVGFIRSKPYGETTTYAAW

SEQ ID NO: 1087 - protein, 19 aa, Homo sapiens
  SIGNAL -14..-1
MSLFXLXXLRQSFTXXAQA

SEQ ID NO: 1088 - protein, 30 aa, Homo sapiens
  SIGNAL -19..-1
MISAHCSFYFLASSSLSTSASXRTGITDVS

SEQ ID NO: 1089 - protein, 43 aa, Homo sapiens
  SIGNAL -24..-1
MNAENNFFGFVCLFVFLYTTPCNCFGLEHLWILSFMVVLGXTR

SEQ ID NO: 1090 - protein, 31 aa, Homo sapiens
  SIGNAL -23..-1
MTMAVGAAXXLPCCCHLLTCVSSLRXDIYPH

SEQ ID NO: 1091 - protein, 34 aa, Homo sapiens [sequence omitted]

SEQ ID NO: 1092 - protein, 30 aa, Homo sapiens
  SIGNAL -23..-1
MGSPYVAHVGLELLTSSDPPSLASQVLGIH

SEQ ID NO: 1093 - protein, 45 aa, Homo sapiens
  SIGNAL -19..-1
MHLYTHVCWLTLTLAHSHSLTHTHTLTPSHTRTHSHTCACLHAHK

SEQ ID NO: 1094 - protein, 51 aa, Homo sapiens
  SIGNAL -15..-1
MRLSLTFYHFPLCWGHQAVPTWWXXIIQPCHCALCTSAEGVQSHIISXIYR

SEQ ID NO: 1095 - protein, 80 aa, Homo sapiens [sequence omitted]

SEQ ID NO: 1096 - protein, 116 aa, Homo sapiens
  SIGNAL -20..-1
MSRRSMLLAWALPSLLRLGAAQETEDPACCSPIVPRNEWKALASECAQHLSLPLRYVVVSHTAGSSCNTXASCQQQARNVQHYHMKTLGWCDVGYNXLDWRRRARIXGPWXELHGX

SEQ ID NO: 1097 - protein, 19 aa, Homo sapiens
  SIGNAL -14..-1
MVFLFLMISVFAGCQIPSG

SEQ ID NO: 1098 - protein, 38 aa, Homo sapiens
  SIGNAL -21..-1
MGSRPVSXAGLELLASSNSSALPFQCSGITGMSXHTLA

SEQ ID NO: 1099 - protein, 19 aa, Homo sapiens
  SIGNAL -13..-1
MLCHLSLVFLGXGQFWSQN

SEQ ID NO: 1100 - protein, 30 aa, Homo sapiens [sequence omitted]

SEQ ID NO: 1101 - protein, 48 aa, Homo sapiens
  SIGNAL -27..-1
MLGYIWXQDKVFANCVLFTLLVSTRSGRSRAGCAWRWRGRWSVGQKGX

SEQ ID NO: 1102 - protein, 28 aa, Homo sapiens
  SIGNAL -15..-1
MXLILSLQVCRPATLDQATRATTPCRLR

SEQ ID NO: 1103 - protein, 41 aa, Homo sapiens [sequence omitted]

SEQ ID NO: 1104 - protein, 36 aa, Homo sapiens [sequence omitted]

SEQ ID NO: 1105 - protein, 30 aa, Homo sapiens
  SIGNAL -25..-1
MLTNLFFQVAHPLIIILXFDIYSLAFIHDV

SEQ ID NO: 1106 - protein, 27 aa, Homo sapiens
  SIGNAL -14..-1
MLFGLRGMLPLTQQAPIPHLRCKLSVT

SEQ ID NO: 1107 - protein, 79 aa, Homo sapiens
  SIGNAL -21..-1
MRVCMRLCACVYACVCASVSACVYXCVCMXVRAHLCVCMCVCMCVHLCVCMCVCVCASVCVCMCACVCMCVCVRASVCV

SEQ ID NO: 1108 - protein, 23 aa, Homo sapiens
  SIGNAL -21..-1
MVITSNSYLIANLVLFISIAALR

SEQ ID NO: 1109 - protein, 57 aa, Homo sapiens [sequence omitted]

SEQ ID NO: 1110 - protein, 27 aa, Homo sapiens
  SIGNAL -25..-1
MVSGAQAPSSQRPLLLCPLSSGSPCPR

SEQ ID NO: 1111 - protein, 32 aa, Homo sapiens [sequence omitted]

SEQ ID NO: 1112 - protein, 67 aa, Homo sapiens [sequence omitted]

SEQ ID NO: 1113 - protein, 54 aa, Homo sapiens
  SIGNAL -48..-1
MALLGKRCDVPTNGCGPDRXXXGXNPQXRDHHQXXVCLRLHVLSAVQTERRGDG

SEQ ID NO: 1114 - protein, 37 aa, Homo sapiens [sequence omitted]

SEQ ID NO: 1115 - protein, 49 aa, Homo sapiens
  SIGNAL -26..-1
MLCACKARGVMLLLFSGWLVWWGSRSSQXLRMPEXXVSGEGRSDXXPHG

SEQ ID NO: 1116 - protein, 51 aa, Homo sapiens
  SIGNAL -42..-1
MISSSLSGRVPVILGNLMGVGAAVRRMGFSLILPTSPSPAHSGSAPSAGPR

SEQ ID NO: 1117 - protein, 56 aa, Homo sapiens
  SIGNAL -46..-1
MGIIQXILATSRDCYSFKKKPIPKKPTMLALAKILLISTLFYSLLSGSHGKXNQDV

SEQ ID NO: 1118 - protein, 29 aa, Homo sapiens
  SIGNAL -23..-1
MMLSTFSYACLPFVCLLLRNVYSDLLPNR

SEQ ID NO: 1119 - protein, 30 aa, Homo sapiens
  SIGNAL -24..-1
MLAILTGGRWYLIVVLVCISLVIIDDDEHG

SEQ ID NO: 1120 - protein, 18 aa, Homo sapiens
  SIGNAL -14..-1
MLLPLGLKVLGLQARGTT

SEQ ID NO: 1121 - protein, 48 aa, Homo sapiens
  SIGNAL -28..-1
MRPTMEFHSVLCGVTPTLLVMWLSPQMASSPSQAPGMEPCASGISQRA

SEQ ID NO: 1122 - protein, 52 aa, Homo sapiens
  SIGNAL -33..-1
MGKKKIWTPSSYPMPSHKHVSLCLLTVAVLVLTFKSLIHFEXIFAYEIGVQG

SEQ ID NO: 1123 - protein, 31 aa, Homo sapiens [sequence omitted]

SEQ ID NO: 1124 - protein, 34 aa, Homo sapiens
  SIGNAL -24..-1
MLQLSFSVFILIMFVCMCVCVCVCVYRLFSSSSP

SEQ ID NO: 1125 - protein, 101 aa, Homo sapiens
  SIGNAL -91..-1
MKSTVSSREVATVDKMKRRHAEYCAQGLQRFKAQLSQDTLPXHPHLEXEKGLEGLEENVPLKGEKPGEGGPESPKKRRRVLLGAGIPPVSSAPRRQSQQAT

SEQ ID NO: 1126 - protein, 36 aa, Homo sapiens
  SIGNAL -20..-1
MHNSCRPVHLFFFFFXETGSRSNXWLEXSGAIIANS

SEQ ID NO: 1127 - protein, 44 aa, Homo sapiens
  SIGNAL -42..-1
MEAYLNDSLLTPSDSPDFESVQAGPXARPTFRLYLSLPVSQAGP

SEQ ID NO: 1128 - protein, 70 aa, Homo sapiens
  SIGNAL -14..-1
MPALGPALLQGSLXRVGPHPPAPSTNCIHSQWHVSAAXGKGPHLRHPLXGXYQLPVPAEPWAAAGGHSVH

SEQ ID NO: 1129 - protein, 21 aa, Homo sapiens
  SIGNAL -19..-1
MVGILPLCCSGCVPSLCCSSY

SEQ ID NO: 1130 - protein, 22 aa, Homo sapiens [sequence omitted]

SEQ ID NO: 1131 - protein, 30 aa, Homo sapiens
  SIGNAL -20..-1
MTEFGLSWVFLVAIFKGVHCEGXIGGVGGA

SEQ ID NO: 1132 - protein, 16 aa, Homo sapiens
  SIGNAL -14..-1
MNTVFLLLFFGCFFFE

SEQ ID NO: 1133 - protein, 47 aa, Homo sapiens
  SIGNAL -24..-1
MWASSPWPSAWSCCCLSSSSFIAGRRRGWTQMWLTRPFSPQASSPSA

SEQ ID NO: 1134 - protein, 49 aa, Homo sapiens [sequence omitted]

SEQ ID NO: 1135 - protein, 28 aa, Homo sapiens
  SIGNAL -20..-1
MLTHGASLSLVIFLLTVKHCFRYRVYKT

SEQ ID NO: 1136 - protein, 35 aa, Homo sapiens [sequence omitted]

SEQ ID NO: 1137 - protein, 82 aa, Homo sapiens
  SIGNAL -33..-1
MFASPRRWSSXKAFSGQRTLLSAILSMLSLSFSTTSLLSNYWFVGTQKVPKPLCEKGLAAKCFDMPVSLDGDTNTSTQEVVX

SEQ ID NO: 1138 - protein, 63 aa, Homo sapiens
  SIGNAL -16..-1
MPIHSVFLCAPALVFPRPVAWKAERPSLCFGASLPPLGRSLLGQGSSFISWGTQAAIVELXPH

SEQ ID NO: 1139 - protein, 80 aa, Homo sapiens
  SIGNAL -62..-1
MVYDEKSLSCSHTPATQFLSWDASSVYSFLYILSARVNVDVXXYIRVYILACVFFLSHPLFXXPNGSVYCXRHSPPYLFC

SEQ ID NO: 1140 - protein, 38 aa, Homo sapiens [sequence omitted]

SEQ ID NO: 1141 - protein, 48 aa, Homo sapiens
  SIGNAL -29..-1
MDKVELPPPDLGPSSALNQTLMLLREVLASHDSSVVPLDARQADFVQG

SEQ ID NO: 1142 - protein, 61 aa, Homo sapiens
  SIGNAL -32..-1
MGGTAGWSSQNTHNIXVHHLVWLWFVVPQTITMITPKITEHRPXITDXXIMXTFEXLGELP

SEQ ID NO: 1143 - protein, 30 aa, Homo sapiens
  SIGNAL -18..-1
MCLSVALYLCVCVCVCLIARVYFCIYVCVW

SEQ ID NO: 1144 - protein, 29 aa, Homo sapiens
  SIGNAL -14..-1
MLHLLFGLFPVLWMFLVYFFLSSFFFFFF

SEQ ID NO: 1145 - protein, 22 aa, Homo sapiens
  SIGNAL -18..-1
MYVCXCVYLFCACMCVCAFFFF

SEQ ID NO: 1146 - protein, 55 aa, Homo sapiens
  SIGNAL -36..-1
MKXNNLRRQSPALRHCWRXETDFFLFTLIGASLLQSASGPCRISXXLKWHSKGTL

SEQ ID NO: 1147 - protein, 54 aa, Homo sapiens
  SIGNAL -20..-1
MWPKXGLLGLGLPLLPPNHPSVAQGTLVSSHSGSGSEGRVALRSDVHSPKTTXQ

SEQ ID NO: 1148 - protein, 135 aa, Homo sapiens
  SIGNAL -42..-1
MYLIRESHASGSSSVTSSCSLXSXSPNPQAMAXLFLSAPPQAEVTFEDVAVYLSREEWGRLGPAQRGXYRDVMLETYXNXVSLGVGPAGPKXGVISQLERGDEPWVLDVQGTSGKEHLKKSTAQLLGPELKYKEL

SEQ ID NO: 1149 - protein, 55 aa, Homo sapiens
  SIGNAL -37..-1
MIPRRTSASRAPSVPQNAGLSPLPALSSLCVSWGTSSTVTRLRPWISPTWTSRAR

SEQ ID NO: 1150 - protein, 56 aa, Homo sapiens
  SIGNAL -14..-1
MVCIFCFLTSKAFPNPRSQDFLLDFSRHXIGLGFTFRSAMHFENFRLXGLGQDSLC

SEQ ID NO: 1151 - protein, 25 aa, Homo sapiens
  SIGNAL -20..-1
MXXYXXXGFCSVTSSPLASAGRTTR

SEQ ID NO: 1152 - protein, 38 aa, Homo sapiens
  SIGNAL -23..-1
MSLXXLCDPDLVPCPLLISVALSVKFHIXQQVNLPCSS

SEQ ID NO: 1153 - protein, 80 aa, Homo sapiens
  SIGNAL -39..-1
MMILILILEHIVTXKRNPKPVTVPAFLXPCLTSFSCXGASFSLXGXRRGWQHGSCCSTIPLFXTLNSLGQGLIGPAYIGA

SEQ ID NO: 1154 - protein, 19 aa, Homo sapiens [sequence omitted]

SEQ ID NO: 1155 - protein, 67 aa, Homo sapiens
  SIGNAL -31..-1
MEEQETEEVGGRSSRKNAATVNAASLPPCFGVKSCRCRRCSCRRCLLYFSWPRGRISPPVGQCAGRG

SEQ ID NO: 1156 - protein, 145 aa, Homo sapiens
  SIGNAL -33..-1
MRGIQAKGSPGQSSAXVLXPCCCHAGASSGATAWEETPRSRCHIAVXSTNTASRGRTWCRATGPCPSGPTRGVSRSRGLGAGFLSPFCCLFAFHPRLPWCAEVPVPAAAHHMRCGGDLLAAPPPGPSWFARFPPLVPESFPHHSV

SEQ ID NO: 1157 - protein, 34 aa, Homo sapiens
  SIGNAL -24..-1
MFSSRSFMVSGLIWVFGLVSVLSXFLCMVYDQGQ

SEQ ID NO: 1158 - protein, 31 aa, Homo sapiens [sequence omitted]

SEQ ID NO: 1159 - protein, 41 aa, Homo sapiens [sequence omitted]

SEQ ID NO: 1160 - protein, 24 aa, Homo sapiens
  SIGNAL -20..-1
MPCSWSHIVSSLFSWLLSLTSVPG

SEQ ID NO: 1161 - protein, 31 aa, Homo sapiens
  SIGNAL -28..-1
MFFFGYSEDIYCVSGPVLSCCCLTAGRARLW

SEQ ID NO: 1162 - protein, 58 aa, Homo sapiens [sequence omitted]

SEQ ID NO: 1163 - protein, 20 aa, Homo sapiens
  SIGNAL -18..-1
MQLLYLTYSLAFLLFIKAGT

SEQ ID NO: 1164 - protein, 24 aa, Homo sapiens [sequence omitted]

SEQ ID NO: 1165 - protein, 57 aa, Homo sapiens
  SIGNAL -42..-1
MLASAPRLNSADRPMKTSVLRQRKGSVRKQHLLSWAXQXGRXQVVEILQSEKQTXXD

SEQ ID NO: 1166 - protein, 47 aa, Homo sapiens
  SIGNAL -38..-1
MYPLGRGEQGPAAPKSWLLLPTTLALHGSLDAVSQAQGRPGHPDAPP

SEQ ID NO: 1167 - protein, 21 aa, Homo sapiens
  SIGNAL -16..-1
MRVFIAALFTIAETWNQPKCP

SEQ ID NO: 1168 - protein, 55 aa, Homo sapiens
  SIGNAL -30..-1
MAKGLRVNLGELVESMRLCFLSVHFRLRWGDSCPSSPHRETFPAGPVNGPLYHPR

SEQ ID NO: 1169 - protein, 87 aa, Homo sapiens
  SIGNAL -17..-1
MPSPQLLVLFGSQTGTAQDVSERLGREARGRRLGCRVQALDSYPVVNLINEPLVIFVCATXGQGDPPDNMKNFWRFIFRKNLPSTAR

SEQ ID NO: 1170 - protein, 48 aa, Homo sapiens
  SIGNAL -41..-1
MSSILGVSSSWWYLYYGYCIFVKKCSFCSFLFLACIFQGXSXXXNTQS

SEQ ID NO: 1171 - protein, 51 aa, Homo sapiens
  SIGNAL -28..-1
MGSVLGLCSMASWIPCLCGSAPCLLCRCCPSGNNSTVTRLIYALFLLVGVW

SEQ ID NO: 1172 - protein, 109 aa, Homo sapiens
  SIGNAL -46..-1
MSXXXRLXRQLLSQXRXMTCENEAGAQCQKSSFIGSCSVMSSGALCVPLYYLAKGNMCSICGMLKEMNGLWSECDSLKNTFIVWXCIFSCLGMQLXSSXVSNVRLLLSH

SEQ ID NO: 1173 - protein, 64 aa, Homo sapiens [sequence omitted]

SEQ ID NO: 1174 - protein, 27 aa, Homo sapiens [sequence omitted]

SEQ ID NO: 1175 - protein, 35 aa, Homo sapiens [sequence omitted]

SEQ ID NO: 1176 - protein, 93 aa, Homo sapiens
  SIGNAL -26..-1
MAGAARWVGQXSSAMVCFGCPGGASSRCRSPRGRQASRVPRLENGAQRVVRTMVHLVLQPKRVTLVHPPRGLEPVCTPIAXMXPKSHGLRSSL

SEQ ID NO: 1177 - protein, 47 aa, Homo sapiens
  SIGNAL -34..-1
MGVVSGGVGDLTTKTQENGLLPXLLSXLHGLLYGSPDAELTGPDPWD

SEQ ID NO: 1178 - protein, 17 aa, Homo sapiens
  SIGNAL -15..-1
MGFLSXTCVLSCXRSLS

SEQ ID NO: 1179 - protein, 48 aa, Homo sapiens
  SIGNAL -39..-1
MEYGSAKLSSGRVFYLPRDFGIERRVLVCFFNSVSFLFGVSXKKSXQW

SEQ ID NO: 1180 - protein, 17 aa, Homo sapiens
  SIGNAL -13..-1
MLSGLVLNSWALAYQLA

SEQ ID NO: 1181 - protein, 23 aa, Homo sapiens
  SIGNAL -16..-1
MRLVFFXGXSIILVLGSTFXAYL

SEQ ID NO: 1182 - protein, 35 aa, Homo sapiens [sequence omitted]

SEQ ID NO: 1183 - protein, 58 aa, Homo sapiens
  SIGNAL -14..-1
MFIAALFTVAKIWNQPKCPSTDEWINKMWYIYTMEYYPDIKKNGILTFKATRMNRKTL

SEQ ID NO: 1184 - protein, 31 aa, Homo sapiens
  SIGNAL -15..-1
MCVCGCLCVWMCVCGXVCIYIXVYVCTCVRG

SEQ ID NO: 1185 - protein, 61 aa, Homo sapiens
  SIGNAL -26..-1
MGVRTVCHFIQVFLSLFVFFWLVGFSFFFFLXFSTKQVRVEQHCDFKSTPXVESSSTVGHA

SEQ ID NO: 1186 - protein, 63 aa, Homo sapiens [sequence omitted]

SEQ ID NO: 1187 - protein, 37 aa, Homo sapiens [sequence omitted]

SEQ ID NO: 1188 - protein, 40 aa, Homo sapiens
  SIGNAL -37..-1
MRRAWTQEREPRPCEPAERADPAPVSCLSAGLRVCCSQRS

SEQ ID NO: 1189 - protein, 37 aa, Homo sapiens
  SIGNAL -25..-1
MLHLICISLIVNDFFICLLAICVSSFENCLFMSLAHS

SEQ ID NO: 1190 - protein, 96 aa, Homo sapiens
  SIGNAL -63..-1
MRSERPMVWCCLFVRSQRKRKQSTQDEDAVSLCSLDISEPSNKRVKPLSRVTSLANLIPPVKAXPLKRFSQTLQRSISFRSESRPDILAPRPWSRN

SEQ ID NO: 1191 - protein, 48 aa, Homo sapiens [sequence omitted]

SEQ ID NO: 1192 - protein, 65 aa, Homo sapiens
  SIGNAL -37..-1
MASLLCCGPKLAACGIVLSAWGVIMLIMLGIFFNVHSAVLIEDVPFTEKDFENGPQNIYNLYEHG

SEQ ID NO: 1193 - protein, 28 aa, Homo sapiens
  SIGNAL -16..-1
MSVSALLLEXLQXAIPRXTSGXQDLPNW

SEQ ID NO: 1194 - protein, 50 aa, Homo sapiens [sequence omitted]

SEQ ID NO: 1195 - protein, 67 aa, Homo sapiens
  SIGNAL -62..-1
MMLRGGGTFKXCLSHEGSSFTKGLAQECVSXSCGTRLITAVASXYKARLPLAACPLLLPIFSHARSS

SEQ ID NO: 1196 - protein, 68 aa, Homo sapiens
  SIGNAL -40..-1
MAKNPPENCEDCHILNAEAFKSKKICKSLKICGLVFGILALTLIVLFWGSKHFWPEVPKKAYDMEHTT

SEQ ID NO: 1197 - protein, 82 aa, Homo sapiens
  SIGNAL -41..-1
MSPAPDAAPAPASISLFDLSADAPVFQGLSLVSHAPGEALARAPRTSCSGSGERESPERKLLQGPMDISEKLFCSTCDQTFQ

SEQ ID NO: 1198 - protein, 56 aa, Homo sapiens
  SIGNAL -35..-1
MLLHYLKLKGDQWKLSSVSTLILFIFIGSLQPVPTRFKRFSCLXHLSSRDHRQALR

SEQ ID NO: 1199 - protein, 184 aa, Homo sapiens
  SIGNAL -153..-1
MAEGDNRSTNLLAAETASLEEQLQGWGEVMLMADKVLRWERAWFPPAIMGVVSLVFLIIYYLDPSVLSGVSCFVMFLCLADYLVPILAPRIFGSNKWTTEQQQRFHEICSNLVKTRRRAVGWWKRLFTLKEEKPKMYFMTMIVSLAAVAWVGQQVHNLLLTYLIVTSLLLLPGLNQHGIILKYI

SEQ ID NO: 1200 - protein, 101 aa, Homo sapiens
  SIGNAL -26..-1
MAALKALVSGCGRLLRGLLAGPAATSWSRLPARGFREVVETQEGKTTIIEGRITATPKESPNPPNPSGQCPICRWNLKHKYNYDDVLLLSQFIRPHGGMLP

SEQ ID NO: 1201 - protein, 44 aa, Homo sapiens
  SIGNAL -23..-1
MGSLLFIRQTLVGFKQVVAWTFASDSHCXXVXMVXXSQLXNPPL

SEQ ID NO: 1202 - protein, 48 aa, Homo sapiens
  SIGNAL -24..-1
MLARAAEXTGALLLRGSLLASXRAXXXPPLGLXRNTXGTVRAAAGGLG

SEQ ID NO: 1203 - protein, 28 aa, Homo sapiens
  SIGNAL -17..-1
MNASLLSFCLCSDFISQDALLLTVIFPP

SEQ ID NO: 1204 - protein, 79 aa, Homo sapiens
  SIGNAL -60..-1
MLNMEPYTVSGMARQDSSSEVGENGRSVDQGGGGSPRKKVALTENYELVGVIVHSGQAHAGHYYSFIKDRRGCGKGKWL

SEQ ID NO: 1205 - protein, 23 aa, Homo sapiens
  SIGNAL -20..-1
MXXAHFSLHLXSSRXPPILASPV

SEQ ID NO: 1206 - protein, 33 aa, Homo sapiens [sequence omitted]

SEQ ID NO: 1207 - protein, 84 aa, Homo sapiens
  SIGNAL -29..-1
MRGCQLLGLRSSWPGDLLSARLLSQEKRAAETHFGFETVSEEEKRGDLTSVVSLEYPEVQLQGQRVYAFLSPICTYGSEGCSLK

SEQ ID NO: 1208 - protein, 55 aa, Homo sapiens
  SIGNAL -35..-1
MENLPFPLKLLSASSLNTPSSTPWVLDIFLTLVFALGFFFLLLPYFSYLRCDNPP

SEQ ID NO: 1209 - protein, 20 aa, Homo sapiens
  SIGNAL -13..-1
MCVCVFAIFGVRCCVCVRCI

SEQ ID NO: 1210 - protein, 46 aa, Homo sapiens
  SIGNAL -44..-1
MICIFYSKISISVGCGRTAAEQVGCKQRSFHXPCPLLFPGACFPCP

SEQ ID NO: 1211 - protein, 29 aa, Homo sapiens
  SIGNAL -16..-1
MNLICVSLMASDGASSPVLGGSSHSSSXX

SEQ ID NO: 1212 - protein, 59 aa, Homo sapiens
  SIGNAL -47..-1
MGSVTGAVLKTLLLLSTQNWNRVEAGNSYDCDDPLVSALPQASFSSSSELSSSHSPGFA

SEQ ID NO: 1213 - protein, 47 aa, Homo sapiens
  SIGNAL -31..-1
MMSEXSQDLVVKCAPPXPFFLLFLFSSCDVPVPLHLLQWLQSFLRPR

SEQ ID NO: 1214 - protein, 59 aa, Homo sapiens
  SIGNAL -27..-1
MFRCVRFLPSGGFVVLLTSGVKPQTFAVSVTALKGGMPGVVHSSGGFVVLLTSGAXCRP

SEQ ID NO: 1215 - protein, 52 aa, Homo sapiens
  SIGNAL -30..-1
MRVGRREGHPLFPNVPRCLFLNARLAGTLCQLKLLQFGRLGNTESHLHGLAG

SEQ ID NO: 1216 - protein, 33 aa, Homo sapiens [sequence omitted]

SEQ ID NO: 1217 - protein, 47 aa, Homo sapiens
  SIGNAL -31..-1
MLFIFSDIDWKMDLCFFSFSPFLPSLPLLEAERMRVSDQLQYTTGXG

SEQ ID NO: 1218 - protein, 61 aa, Homo sapiens
  SIGNAL -36..-1
MELEAMSRYTSPVNPAVFPHLTVVLLAIGMFFTAWFFVYEVTSTKYTRDIYKELLISLVAR

SEQ ID NO: 1219 - protein, 38 aa, Homo sapiens
  SIGNAL -17..-1
MKGALKLISTNFSLCQSVQCPSEETITDLVSVPCQXGL

SEQ ID NO: 1220 - protein, 93 aa, Homo sapiens
  SIGNAL -69..-1
MTSQPVPNETIIVLPSNVINFSQAEKPEPTNQGQDSLKKHLHAEIKVIGTIQILCGMMVLSLGIILASASFSPNFTQVTSTLLNSAYPFIGPG

SEQ ID NO: 1221 - protein, 55 aa, Homo sapiens
  SIGNAL -40..-1
MVDECLTEPVWGSKRQGCSSQAEASCDIVSAACKCGSSQAAIDCETSSCSEDFPV

SEQ ID NO: 1222 - protein, 31 aa, Homo sapiens
  SIGNAL -14..-1
MAWWFSGTFPLTHPCSGYGSLMAPSSPTPSG

SEQ ID NO: 1223 - protein, 78 aa, Homo sapiens
  SIGNAL -57..-1
MVAKDYPFYLTVKRANCSLELPPASGPAKDAEEPSNKRVKPLSRVTSLANLIPPVKATPLKRFSQTLQRSISFRSESA

SEQ ID NO: 1224 - protein, 94 aa, Homo sapiens
  SIGNAL -28..-1
MSPAFRAMDVEPRAKGVLLEPFVHQVGGHSCVLRFNETTLCKPLVPREHQFYETLPAEMRKFTPQYKGQSQRPLVSWPSLPHFFPWSFPLWPQG

SEQ ID NO: 1225 - protein, 85 aa, Homo sapiens
  SIGNAL -34..-1
MLGGAVIAGRPLGRWESTAQXILAFLQSPRAILPGNFFEKNAQIQGGPWGGGSGKTCAPGRXDPGWECGAGGGXGEAAGSRXRXS

SEQ ID NO: 1226 - protein, 31 aa, Homo sapiens
  SIGNAL -16..-1
MSMACFFHLFVSSLISFEQCFXMLRKLLKII

SEQ ID NO: 1227 - protein, 79 aa, Homo sapiens
  SIGNAL -45..-1
MGSRGDPLICGLQRSVGEVWFPGWGHTITHCFPWLEVGLFFWLHAAPGRAIALPHFSSFSVGQXVHLVSPLXXLDISVE

SEQ ID NO: 1228 - protein, 55 aa, Homo sapiens
  SIGNAL -19..-1
MHLLQEELLLLLPRGLCQVCPRLCLQRXVGELQXXXPDVGTALLPDVNRTSCTTW

SEQ ID NO: 1229 - protein, 39 aa, Homo sapiens
  SIGNAL -28..-1
MCLSCIQGSFFVEILQLVTRLLLSPSQSTQTHTHTHTHT

SEQ ID NO: 1230 - protein, 39 aa, Homo sapiens
  SIGNAL -32..-1
MTILREMXXSLYVLEAKDTAILLLVXVSDKNEQQLGRGV

SEQ ID NO: 1231 - protein, 51 aa, Homo sapiens [sequence omitted]

SEQ ID NO: 1232 - protein, 89 aa, Homo sapiens
  SIGNAL -68..-1
MLLTRPAVSAGGAXRFSPGSRGRGSDLERGLCPAHPGAPPLPRPPDRLPHSFSPTGCLLXPLLVSCLGSLLPVTQTLGSFSAGPCFRTL

SEQ ID NO: 1233 - protein, 46 aa, Homo sapiens
  SIGNAL -25..-1
MHSLCPLSQFLPILXSLSSSVPSRAGSAFPSALGPLYQPLLGPPAW

SEQ ID NO: 1234 - protein, 59 aa, Homo sapiens
  SIGNAL -44..-1
MRTQVYEGLCKNYFSLAVLQRDRIKLLFFDILVFLSVXLLFLLFLVDIMANXTTSLGRP

SEQ ID NO: 1235 - protein, 109 aa, Homo sapiens
  SIGNAL -45..-1
MGQFTAAMVGRISCLGVWKLPRVESCSQPARPLLSLAQTTTKTTATTTTTTKHATCALAYTNTPTEPXQADKASRRASGXLXXAARHIPWHGATAAQLPAPPPSVISAL

SEQ ID NO: 1236 - protein, 28 aa, Homo sapiens
  SIGNAL -18..-1
MLIFIIAILFPNSGSCFAFSCHVSFFFF

SEQ ID NO: 1237 - protein, 58 aa, Homo sapiens
  SIGNAL -15..-1
MVRCACFPFFPFAFCHDCKFLGASQSCFLLSRQNCVSTGXPSSKSDINSRSGSCSLAR

SEQ ID NO: 1238 - protein, 98 aa, Homo sapiens
  SIGNAL -27..-1
MVSLRVGASPFRFPLAPLXLVFISLLPAPFFPTLSFPCCCVSWLFSLSVXVSLRLSLXVSCLSLWCLLVLFLSPTLYVSDSFCSFCVLPIALCPXARS

SEQ ID NO: 1239 - protein, 72 aa, Homo sapiens
  SIGNAL -54..-1
MAHPCLAPAEPSTLSQTXHPIQRTLTTFPQAWVLTSSFSIQPGLAFLAILTVLAKPGSSXWSPGQFTPHSLL

SEQ ID NO: 1240 - protein, 35 aa, Homo sapiens
  SIGNAL -31..-1
MHFPIQATFXYSPTDSLCHLYXSLFSSFLCSTPAR

SEQ ID NO: 1241 - protein, 61 aa, Homo sapiens [sequence omitted]

SEQ ID NO: 1242 - protein, 58 aa, Homo sapiens
  SIGNAL -32..-1
MSCTHSSSNLGKFSVHREYRVLXLCNSRVSFTRXHVKRPPXRLCVSSKGCLFHLGAGR

SEQ ID NO: 1243 - protein, 40 aa, Homo sapiens
  SIGNAL -19..-1
MLKKLSAFPLLLVIILLFQKQXGLLKNYXSPQRQVLFCNR

SEQ ID NO: 1244 - protein, 29 aa, Homo sapiens
  SIGNAL -18..-1
MSYFRCIFLAVLSKISWAVNMCSLISGSS

SEQ ID NO: 1245 - protein, 39 aa, Homo sapiens [sequence omitted]

SEQ ID NO: 1246 - protein, 90 aa, Homo sapiens
  SIGNAL -39..-1
MCQARIALDRCNLRTAFILFXLILSHYVFXLLAPFLTRSSPSWNSYGTLAPETTNSSLKFSNSNNGISDLAXLYFSHVXKIGSASTMGYG

SEQ ID NO: 1247 - protein, 99 aa, Homo sapiens
  SIGNAL -24..-1
MVKSVIFLSFWQGMLLAILEXCGAIPKIHSARVSVGEGTVAAGYQDFIICVEMFFAALALRHAFTYKVYADKRLDAQVPTYGPYGRCAPMKSISSSLKE

SEQ ID NO: 1248 - protein, 88 aa, Homo sapiens
  SIGNAL -86..-1
MDMRWHCENSQTTDDILVASAECPSDDEDIDPCEPSSGGLANPTRAGGREPYPGSAEVIRESSSTTGMVVGIVAAAALCILILLXAMY

SEQ ID NO: 1249 - protein, 125 aa, Homo sapiens
  SIGNAL -20..-1
MAWTPLWPTLLTLCIGSVVSSDLTQDPAVSVALGQRVRITCQGDNLEEYFASWYRQRPGQAPVLVIYGKNNRPSGIPXRXSGSKSGNTALLTIXGAQAEDXADYYCSXRDHTDNRWVFGGGTRLT

SEQ ID NO: 1250 - protein, 70 aa, Homo sapiens
  SIGNAL -20..-1
MEAEFYMXILTCLIFRNSEGFQIXHVQKQQCLFKNEKVVVGSCNRTIQNQQWMWTEDEKLLHVKSALCLA

SEQ ID NO: 1251 - protein, 19 aa, Homo sapiens
  SIGNAL -17..-1
MCVCACALCVWLCVKSCSI

SEQ ID NO: 1252 - protein, 34 aa, Homo sapiens
  SIGNAL -21..-1
MISDVQHLFIYLLAFCMPSLEKCLYGSLAHFFFF

SEQ ID NO: 1253 - protein, 28 aa, Homo sapiens
  SIGNAL -15..-1
MPLFRVLFSXTCALXQDFRMQPCPPTPK

SEQ ID NO: 1254 - protein, 30 aa, Homo sapiens [sequence omitted]

SEQ ID NO: 1255 - protein, 54 aa, Homo sapiens
  SIGNAL -30..-1
MAARVGAFLKNAWDKEPVLVVSFVVGGLGCNXAPIEPLLQVLRHDQQGHALQLX

SEQ ID NO: 1256 - protein, 103 aa, Homo sapiens
  SIGNAL -23..-1
MQARRWESWMWTCVAPVYPACSGRRAXAVXQXXPRLGXXLPGPGXEHLAHVCGLPAGEAGRGRGVERPQEKRADKAVXVRRGLGGAGLPGGDTPRGPPMSTWP

SEQ ID NO: 1257 - protein, 16 aa, Homo sapiens
  SIGNAL -14..-1
MFLFFFGNSPCCGATG

SEQ ID NO: 1258 - protein, 40 aa, Homo sapiens
  SIGNAL -25..-1
MGLSHHRVSAPSSLSLSLSASLIISPSPSASPSLLXPPXR

SEQ ID NO: 1259 - protein, 32 aa, Homo sapiens
  SIGNAL -23..-1
MFVFLVGTPCLSMLLRLVSNSRPPVMRPPRPG

SEQ ID NO: 1260 - protein, 42 aa, Homo sapiens [sequence omitted]

SEQ ID NO: 1261 - protein, 42 aa, Homo sapiens [sequence omitted]

SEQ ID NO: 1262 - protein, 26 aa, Homo sapiens [sequence omitted]

SEQ ID NO: 1263 - protein, 69 aa, Homo sapiens
  SIGNAL -53..-1
MGRGPGPLQERSLFEXKRGAPPSSNIEDFHGLLPKVIPICALYVICQFILIRSGVNISMEQVTVVDASL

SEQ ID NO: 1264 - protein, 40 aa, Homo sapiens
  SIGNAL -13..-1
MLYCVVVVHSVCCAVYYFVIIHTIEHITYLCIHSTILLCV

SEQ ID NO: 1265 - protein, 37 aa, Homo sapiens
  SIGNAL -26..-1
MCWLRXWGQILLPVFXSLFLIQLLISFSENGFIHSPM

SEQ ID NO: 1266 - protein, 21 aa, Homo sapiens
  SIGNAL -14..-1
MCGLXILCGPWLHAAPPSPPR

SEQ ID NO: 1267 - protein, 42 aa, Homo sapiens
  SIGNAL -33..-1
MFHGRVMAMGXLTKHLNLNISISLLLMLXXYWSCWIKSPPXM

SEQ ID NO: 1268 - protein, 132 aa, Homo sapiens
  SIGNAL -128..-1
MLGRSSLLXWKXSPGSKKLVVATEKNVIAALNSRTGEILWRHVDKGTAEGAVDAMLLHGQDVITVSNGGRIMRSWETNIGGLNWEITLDSGSFQALGLVGLQESVRYIAVLKKTTLALHHLSSGHSSGWTSP

SEQ ID NO: 1269 - protein, 72 aa, Homo sapiens
  SIGNAL -57..-1
MSTTYLNEDLKKKFSAVIEQVLFAHLSPLHVWLQLRSLCEXLTCIWVRFNFLASSQACSKCNSSFLIMSSSS

SEQ ID NO: 1270 - protein, 80 aa, Homo sapiens
  SIGNAL -39..-1
MALIVLQLTFGIGYVTLLQIHSIYSQLIILDLLVPVIGLITELPLHIRETLLFTSSLILTLNTVFVLAVKLKWFYYSTRY

SEQ ID NO: 1271 - protein, 54 aa, Homo sapiens
  SIGNAL -24..-1
MRVAGAAKLVVXVAXFLLTFYVISQVFEIKMDASLGNLFARSALDTAARSTKPP

SEQ ID NO: 1272 - protein, 54 aa, Homo sapiens
  SIGNAL -15..-1
MHTLVFLSTRQVLQCQPAACQALPLLPRELFPLLFKVAFMXKKTVVLRXLVHTR

SEQ ID NO: 1273 - protein, 16 aa, Homo sapiens
  SIGNAL -14..-1
MTVVISCLVGECGSWK

SEQ ID NO: 1274 - protein, 72 aa, Homo sapiens
  SIGNAL -47..-1
MCTLTDTHTHVQVHKSKPCQLLSPPPPXHGPLLLPIFGLLVPSQIFSSLLNSLHLGLPSFPKMPLMIFLPRW

SEQ ID NO: 1275 - protein, 78 aa, Homo sapiens
  SIGNAL -63..-1
MTLILGESSSQPQISIFLWTKVKDLFSLMITWTVQMKLTSMWMNLIPPMKQILXSTLAMKIHSQQRFWPRVRVYSRIY

SEQ ID NO: 1276 - protein, 25 aa, Homo sapiens
  SIGNAL -19..-1
MYKEKLVLFLLNLFQKIEEEELFPN

SEQ ID NO: 1277 - protein, 88 aa, Homo sapiens
  SIGNAL -48..-1
MDSVPATVPSIAATPGDPELVGPLSVLYAAFIAKLLELVATLPDDVQPGPDFYGXXWKLYLSLPSWEXFVCHFLMETVLVVKXRVYXV

SEQ ID NO: 1278 - protein, 39 aa, Homo sapiens
  SIGNAL -18..-1
MAAYFAVWASVASPASICCGXWLTGLVRHERIEAPWARG

SEQ ID NO: 1279 - protein, 34 aa, Homo sapiens
  SIGNAL -29..-1
MKTQFLSWGKFSFCFGILLILQLLKXSLKKCRHG

SEQ ID NO: 1280 - protein, 40 aa, Homo sapiens
  SIGNAL -25..-1
MLPAVAVSEPVVLRFILPSSWDCRCAPPLLTGFCIFWXET

SEQ ID NO: 1281 - protein, 60 aa, Homo sapiens [sequence omitted]

SEQ ID NO: 1282 - protein, 38 aa, Homo sapiens
  SIGNAL -31..-1
MKMSTPSPLSKKVLRNQVSRLXALLSPYAFTLXRLASG

SEQ ID NO: 1283 - protein, 58 aa, Homo sapiens
  SIGNAL -15..-1
MRRFLLLYATQQGQAKAIAEEMCXQAVVHGFSADLHCISESDKVSVIQNTPTFATGGR

SEQ ID NO: 1284 - protein, 41 aa, Homo sapiens [sequence omitted]

SEQ ID NO: 1285 - protein, 73 aa, Homo sapiens [sequence omitted]

SEQ ID NO: 1286 - protein, 20 aa, Homo sapiens
  SIGNAL -13..-1
MVVVSFLASSSLPAETPKQG

SEQ ID NO: 1287 - protein, 145 aa, Homo sapiens
  SIGNAL -107..-1
MGXLALXAWLQPRYRKNAYLFIYYLIQFCGXSWIFANMTVRFFSFGKDSMVDTFYAIGLVMRLCQSVSLLELLHIYVGIESNHLLPRFLQLTERIIILFVVITSRRGSPTRNMWCVCYSSLDLWIWLXTLIAXXSVIGISYAVLT

SEQ ID NO: 1288 - protein, 21 aa, Homo sapiens [sequence omitted]

SEQ ID NO: 1289 - protein, 84 aa, Homo sapiens
  SIGNAL -20..-1
MGLTKQYLRYVASAVFGVIGSQKGNIVFVTLRGEKGRYVAVPACEHVFIXDLRKGEKILILQGLKQEVTCLCPSPDGLHLAVGY

SEQ ID NO: 1290 - protein, 27 aa, Homo sapiens
  SIGNAL -24..-1
MMGIFLVYVGFVFFSVLYVQQGLSSQA

SEQ ID NO: 1291 - protein, 47 aa, Homo sapiens
  SIGNAL -22..-1
MSLGLHSNSWVLDPALLLTCLTFPIYKLLWVRGGTRXTLXALHSART

SEQ ID NO: 1292 - protein, 68 aa, Homo sapiens
  SIGNAL -60..-1
MAANSSGQGFQNKNRVAILAELTKRKENYLCRTSLQQIILELGIDTIMWVXCXFCFVLFCFETESRPV

SEQ ID NO: 1293 - protein, 138 aa, Homo sapiens
  SIGNAL -35..-1
MSAGSATHPGAGGRRSKWDQPAPAPLLFLPPAAPGGEVTSSGGSPGXTTAAPSGALDAAAAVAAKINAMLMAKGKLKPTQXASEKLQAPGKGLTSNKSKDDLVVAEVEINDVPLTCRNLLTRGQXQDEISRLSGAAVS

SEQ ID NO: 1294 - protein, 58 aa, Homo sapiens [sequence omitted]

SEQ ID NO: 1295 - protein, 19 aa, Homo sapiens
  SIGNAL -15..-1
MNSFHFIXFLPFPWAEXAQ

SEQ ID NO: 1296 - protein, 35 aa, Homo sapiens
  SIGNAL -29..-1
MGWHSHSSQGVXAMPLLLSTHTWTDTALAFSTHTH

SEQ ID NO: 1297 - protein, 35 aa, Homo sapiens
  SIGNAL -22..-1
MXAVRNAGSWFLRSWTWPQTAGRVVARXPAGTICT

SEQ ID NO: 1298 - protein, 23 aa, Homo sapiens
  SIGNAL -15..-1
MCALFILVSISLFYALFISPSIQ

SEQ ID NO: 1299 - protein, 61 aa, Homo sapiens [sequence omitted]

SEQ ID NO: 1300 - protein, 138 aa, Homo sapiens
  SIGNAL -78..-1
MKLKLYLCILGPWGCXXKVPLIGFLKRIXXYXLTVLKPXSLXSXSAGLVPSEDSKKESVSCLSPRFWWWLGSLXVTWLIHASLQSLSPFSHAIFSCVSVFSFAYKDTSHIELGPALITSSQLPLQGTNFQIMSHSHVA

SEQ ID NO: 1301 - protein, 35 aa, Homo sapiens
  SIGNAL -33..-1
MNEKKKLLGTEQKQKKRMGNLKLLFLILILIAGYR

SEQ ID NO: 1302 - protein, 30 aa, Homo sapiens
  SIGNAL -27..-1
MGLQSLTLPVSCSPSALMLPLGCAVRTRML

SEQ ID NO: 1303 - protein, 38 aa, Homo sapiens
  SIGNAL -31..-1
MDSNKKLVLSITGNTVWILTTLESLAGSVXSEQDLSAY

SEQ ID NO: 1304 - protein, 55 aa, Homo sapiens
  SIGNAL -47..-1
MTCMLACRCSLXGPQDFRFCSVFSLLLKLGNFYFSFXXCLFLXLXXSEMESHSFS

SEQ ID NO: 1305 - protein, 113 aa, Homo sapiens
  SIGNAL -65..-1
MEDVEARFAHLLQPIRDLTKNWEVDVAAQLGEYLEELDQICISFDEGKTTMNFIEAALLIHGSACVYSKKVEYLYSLVYQALDFISGKRRAKQLSSVQEDRANGVAAPGSPGG

SEQ ID NO: 1306 - protein, 20 aa, Homo sapiens
  SIGNAL -15..-1
MFVSYLILTLLHVQTAVLAR

SEQ ID NO: 1307 - protein, 60 aa, Homo sapiens [sequence omitted]

SEQ ID NO: 1308 - protein, 30 aa, Homo sapiens
  SIGNAL -23..-1
MRMGTRASPPLCMHLSIHPXXCACICPSIQ

SEQ ID NO: 1309 - protein, 38 aa, Homo sapiens
  SIGNAL -36..-1
MYPRVWGCFQLLHXLXXTRTTGKXVCVCVCVCVCVCVC

SEQ ID NO: 1310 - protein, 100 aa, Homo sapiens
  SIGNAL -14..-1
MAAVVLAATRLLRGSGSWGCSRLRFGPPAYRRFSSGGAYPNIPLSSPLPGVPKPVFATVDGQEKFETKVTTLDNGLRVASQNKFGQFCTVGILINSGSRY

SEQ ID NO: 1311 - protein, 59 aa, Homo sapiens
  SIGNAL -25..-1
MYCLXCVEKIAKALYLSLNLYFANSLYYMCVCSYIYFYLXIYXYXLIKXXSYYVAQTGL

SEQ ID NO: 1312 - protein, 36 aa, Homo sapiens
  SIGNAL -29..-1
MCQLRRGLGKRPLSEASAVFLTAVFSSHSWLVGPRY

SEQ ID NO: 1313 - protein, 33 aa, Homo sapiens
  SIGNAL -31..-1
MSVRSTWCRAQFNSWVSLLTFCLIDLSNVDSGX

SEQ ID NO: 1314 - protein, 88 aa, Homo sapiens
  SIGNAL -53..-1
MVSGVPSGLGKSARPRGRRARKLLPAPRAAPRTAPDYPGPLRLTWLVAAGLEGRVHLADTSSGRKTWPGCGHQWKWKALLILVRAFPA

SEQ ID NO: 1315 - protein, 37 aa, Homo sapiens
  SIGNAL -31..-1
MGGCVXWRFLGHSSALRTVCSSLRSXRPCWCDGLRLR

SEQ ID NO: 1316 - protein, 106 aa, Homo sapiens
  SIGNAL -51..-1
MNSKGQYPTQPTYPVQPPGNSSIPSDLASSSGSTLYRCSTCLLRALSSELCAPRGCHSPHHVSRISWTLSVSSHGPVCGCWAFRFHNPHGLLSSRSHLSXWLHSAG

SEQ ID NO: 1317 - protein, 59 aa, Homo sapiens
  SIGNAL -22..-1
MVVVSAFIYLFFETGSPSVAQSGVQWCDLGLLQPPPPGFKRFSCLSLLGXXDCRRAPPG

SEQ ID NO: 1318 - protein, 103 aa, Homo sapiens
  SIGNAL -24..-1
MFVSXTXFFFXLXFLGMFLSGMVAQIDANWNFLDFAYHFTVFVFYFGAFLLEAAATSLHDLHCNTTITXQPLLSDNQYNINVAASIFAFMTTACYGCSLGLAL

SEQ ID NO: 1319 - protein, 41 aa, Homo sapiens
  SIGNAL -26..-1
MSSEIFXXXXIAYAXYLLVGLFPLKCHXSXFSKXQISSFVE

SEQ ID NO: 1320 - protein, 63 aa, Homo sapiens
  SIGNAL -18..-1
MAASSLTVTLGRLASACSHSILRPSGPGAASLWSASRRFNSQSTSYLPGYVXKTSLSSPPWPR

SEQ ID NO: 1321 - protein, 24 aa, Homo sapiens
  SIGNAL -18..-1
MLIAACICSCLFFSQYLXXSNPAA

SEQ ID NO: 1322 - protein, 30 aa, Homo sapiens
  SIGNAL -16..-1
MKCWVLSYMWQSASLGFSNRIKSXLRPPAG

SEQ ID NO: 1323 - protein, 101 aa, Homo sapiens [sequence omitted]

SEQ ID NO: 1324 - protein, 43 aa, Homo sapiens
  SIGNAL -14..-1
MFAFLAGCSGSCLWSRHFGRLRRAAPLSPEFETGLGNMVEPQW

SEQ ID NO: 1325 - protein, 42 aa, Homo sapiens
  SIGNAL -17..-1
MPTYFLFVPHLISCNWCEPRGNNPQIPLLAIHTRKKNQHFIT

SEQ ID NO: 1326 - protein, 59 aa, Homo sapiens
  SIGNAL -27..-1
MLWTSFQNPLQVVLLTSVSLXXXXXXGSVRIXLSHWSSSAFFFLIXXXXLSHVTKQMHL

SEQ ID NO: 1327 - protein, 31 aa, Homo sapiens
  SIGNAL -14..-1
MLTCLCGCFIVLLVCVLKCVFVVASNGLFFP

SEQ ID NO: 1328 - protein, 40 aa, Homo sapiens
  SIGNAL -29..-1
MVVSFAVQKLFSLIRSHLSILAFVAIAFGVLDMKSLPTPG

SEQ ID NO: 1329 - protein, 104 aa, Homo sapiens
  SIGNAL -65..-1
MGGRKMATDEENVYGLEENAQSRQESTRRLILVGRTGAGKSATGNSILGQRRFFSRLGATSVXRACTTXSRRWDKCHVEVVXLGHXXXGKCPRQILAVRREVTA

SEQ ID NO: 1330 - protein, 80 aa, Homo sapiens
  SIGNAL -31..-1
MQLQVLGRPQGAPQLAPQALALTXTLLPAPGEHDSPMXIGQFPXNPPSEHPGASPRRXXTGWXPQSWDRRVSPAEAETRR

SEQ ID NO: 1331 - protein, 45 aa, Homo sapiens
  SIGNAL -41..-1
MGVYTCPIFVHYYENHGPTPSFXAFISFHLFTLGFLCSLCPHPHG

SEQ ID NO: 1332 - protein, 23 aa, Homo sapiens
  SIGNAL -16..-1
MKKSVSCCSSLWVSLSKDENAEM

SEQ ID NO: 1333 - protein, 39 aa, Homo sapiens
  SIGNAL -30..-1
MLLPLAMAGRCYTAKHSTVLLSGSPRAVVSAVVMVGTGC

SEQ ID NO: 1334 - protein, 26 aa, Homo sapiens
  SIGNAL -19..-1
MPSCCYLRAFLLSVPLGKGSALKDPV

SEQ ID NO: 1335 - protein, 101 aa, Homo sapiens
  SIGNAL -24..-1
MVADKEVQTRTLLLSSLWIVCCLHLDSLISXKYPLHAIRRYLSTLRNQRAEEQVARFQKIPNGENETMIPVLTSKKASELPVSEVASILQADLQNGLKQCE

SEQ ID NO: 1336 - protein, 20 aa, Homo sapiens
  SIGNAL -14..-1
MHICLFFSFSXXFXLFFFFF

SEQ ID NO: 1337 - protein, 45 aa, Homo sapiens
  SIGNAL -19..-1
MWLPCQILARLCRMQTCWCLSFPTSSFTESVMRSLGECPRKRWGG

SEQ ID NO: 1338 - protein, 110 aa, Homo sapiens
  SIGNAL -84..-1
MXKLXSNPSEKGTKPPSVEDGFQTVPLITPLEVNHLQLPAPEKVIVKTRTEYQPEQKNKGKFRVPKIAEFTVTILVSLALAFLACIVFLVVYKAFTYDHSCPEDSSXSTG

SEQ ID NO: 1339 - protein, 51 aa, Homo sapiens
  SIGNAL -21..-1
MFXAAAGVEVLSLLFXCIYWGQYATDGIGNESVKILAKLLFSSSFLIFLLM

SEQ ID NO: 1340 - protein, 35 aa, Homo sapiens
  SIGNAL -26..-1
MLTGRFLGGSQGFFLSFLSFFFFSFFLFLXFFFFF

SEQ ID NO: 1341 - protein, 41 aa, Homo sapiens
  SIGNAL -28..-1
MFIXXXMKQXFHIIDFVFMSKLLLFSFSFLXKARMXTAAPG

SEQ ID NO: 1342 - protein, 37 aa, Homo sapiens [sequence omitted]

SEQ ID NO: 1343 - protein, 19 aa, Homo sapiens
  SIGNAL -15..-1
MLILHLATLLNLFISSNSF

SEQ ID NO: 1344 - protein, 27 aa, Homo sapiens
  SIGNAL -15..-1
MPLASFGPFRSSCFAARSIIWKSGRQG

SEQ ID NO: 1345 - protein, 36 aa, Homo sapiens
  SIGNAL -31..-1
METWNGTSIIVAHLXSFSFLLSFLSFRSPLCHHPLG

SEQ ID NO: 1346 - protein, 26 aa, Homo sapiens
  SIGNAL -14..-1
MQFLSLIFASCSSTTPLPLXQCCTLP

SEQ ID NO: 1347 - protein, 84 aa, Homo sapiens
  SIGNAL -53..-1
MVTSKSRGPXVQTLGHAGNLRSLREWPDLCCLRLFVPDHTVLALVCHSASISVFPSQVTCRLPRTGSHPICVISQGAFHDPHPN

SEQ ID NO: 1348 - protein, 53 aa, Homo sapiens
  SIGNAL -27..-1
MPRSIDXKALIWTVRLVVLFASPXVRPASSMSSRLLLPXLHYSDWTCWLPERR

SEQ ID NO: 1349 - protein, 91 aa, Homo sapiens
  SIGNAL -54..-1
MTSLLTTPSPREELMTTPILQPTEALSPEDGASTALIAVVITVVFLTLLSVVILIFFYLYKNKGSYVXYEPTEGEPSAIVQMEXXLAKGSE

SEQ ID NO: 1350 - protein, 50 aa, Homo sapiens
  SIGNAL -18..-1
MTKAXLIYLVSSFLALNQASLISRCDLAQVLQLEDLDGFEGYSLSDWLCW

SEQ ID NO: 1351 - protein, 36 aa, Homo sapiens [sequence omitted]

SEQ ID NO: 1352 - protein, 91 aa, Homo sapiens
  SIGNAL -30..-1
MGPVPGAAAGVXPXXGELAXTLSLTCSVSGVSITSYYWSWIRQAPGKGPEWIGXIDHSGDTDYNPSLQSRVTLSVDTSKNQFSLRLLSVSA

SEQ ID NO: 1353 - protein, 39 aa, Homo sapiens
  SIGNAL -36..-1
MWFQTRSCGHHDPVGITGVTKVILPLFLCPLGMVETSFG

SEQ ID NO: 1354 - protein, 112 aa, Homo sapiens
  SIGNAL -109..-1
MSYVVTKTKAINGKYHRFLGRHFPRFYVLYTIFMKGLQMLWADAKKARRIKTNMWKHNIKFHQLPYREMEHLRQFRQDVTKCLFLGIISIPPFANYLVFLLMYLFPRQLLIR

SEQ ID NO: 1355 - protein, 57 aa, Homo sapiens [sequence omitted]

SEQ ID NO: 1356 - protein, 81 aa, Homo sapiens
  SIGNAL -79..-1
MQGGNSGVRKREEEGDGAGAVAAPPAIDFPAEGPDPEYDESDVPAXIQVLKEPLQQPTFPFAVANQLLLVSLLEHLSHVHE

SEQ ID NO: 1357 - protein, 21 aa, Homo sapiens [sequence omitted]

SEQ ID NO: 1358 - protein, 65 aa, Homo sapiens
  SIGNAL -43..-1
MLWETDLSTNKTPVSCTAGSACALSLLQFPVLITQLCLGKGQSEPIGPLQDFVSLESTSHFYSFF

SEQ ID NO: 1359 - protein, 32 aa, Homo sapiens
  SIGNAL -20..-1
MTRRRTSLWCCSPSSRTSSSLSWRMGSQIRPS

SEQ ID NO: 1360 - protein, 20 aa, Homo sapiens [sequence omitted]

SEQ ID NO: 1361 - protein, 60 aa, Homo sapiens
  SIGNAL -33..-1
MTLNEHAAFKHLFNKAHLAPPLIHLTLSGHSTCFREHRVGGKVIDEQHPKAEESFLVQEG

SEQ ID NO: 1362 - protein, 29 aa, Homo sapiens
  SIGNAL -26..-1
MSFSSSLPPSLPPSLASFLLLTFLPSLPR

SEQ ID NO: 1363 - protein, 105 aa, Homo sapiens
  SIGNAL -46..-1
MRAQGLSCGYPARPLQPFLEHLAGSGITKRTAPGCAPLRWVPQIRGCPLTRLAQRGADTRTRENLFYSRFPGLQLPAAXXSASALSLCTPRSPPLPLPLPINSPG

SEQ ID NO: 1364 - protein, 52 aa, Homo sapiens [sequence omitted]

SEQ ID NO: 1365 - protein, 43 aa, Homo sapiens
  SIGNAL -39..-1
MPKDADLAFSASLFERAESLYTLISKFXSCXCVSTLAYTKGRG

SEQ ID NO: 1366 - protein, 30 aa, Homo sapiens [sequence omitted]

SEQ ID NO: 1367 - protein, 63 aa, Homo sapiens
  SIGNAL -37..-1
MXGSSRXXGLQITASRTGKVYPACHFLXAVSASSSXACLWYRPIARRPAGPGGSLSSAQVHPA

SEQ ID NO: 1368 - protein, 100 aa, Homo sapiens
  SIGNAL -26..-1
MILFDHLHCSASGVTFWLLCRICTFGFHGFSKYTVSRGTQQGAGXXXGLHQNWEQWRGLVGKSSSAAVVFCLTFDLVTSFQLASAIESTHFHAGRDGSHL

SEQ ID NO: 1369 - protein, 31 aa, Homo sapiens
  SIGNAL -29..-1
MELSLPPSMCDYPXFCLLLFPASLRLLCVHP

SEQ ID NO: 1370 - protein, 27 aa, Homo sapiens [sequence omitted]

SEQ ID NO: 1371 - protein, 45 aa, Homo sapiens
  SIGNAL -23..-1
MSVNXIFIFYFILLLLIQDLTMSPTAGMQWHNHGPPQALPCPLRX

SEQ ID NO: 1372 - protein, 78 aa, Homo sapiens
  SIGNAL -45..-1
MSFLNVDITDCLYNPSVCPVAQSSLTCDFIDGICLGSPLAECLLGXXXXIXGINXXCFPCGVKCAGVVLGLSTLWYVV

SEQ ID NO: 1373 - protein, 49 aa, Homo sapiens [sequence omitted]

SEQ ID NO: 1374 - protein, 30 aa, Homo sapiens
  SIGNAL -17..-1
MESKVLISASLLRASQLKIKXNKMTNFLIL

SEQ ID NO: 1375 - protein, 118 aa, Homo sapiens
  SIGNAL -24..-1
MAASVLNTVLRRLPMLSLFRGSHXXFRFPSRLFAPKLPLRKILCPQFPFLLIRMSPGNIWNQKNTRSDMVLAPSGLTTAATTRVVYPHSGLGRHVFVGIKLLGIPAPSVEITSCMLTL

SEQ ID NO: 1376 - protein, 76 aa, Homo sapiens
  SIGNAL -18..-1
MKSNLTLLTCLXLXGGEGWKGAAVCFETVEQFCSLRKWHVTYLXKDSGLCQQQEKLYTKFLVCIKGASNEEIKKTY

SEQ ID NO: 1377 - protein, 24 aa, Homo sapiens
  SIGNAL -14..-1
MLASPCVLVQGSGXSLVRTPWCPE

SEQ ID NO: 1378 - protein, 46 aa, Homo sapiens
  SIGNAL -19..-1
MNIILEILLLLITIIYSYLESLVKFFIPQRRKSVAGEIVLITGAGH

SEQ ID NO: 1379 - protein, 53 aa, Homo sapiens
  SIGNAL -39..-1
MDLIGFGYAALVTFGSIFGYKXRGGVPSLIAGLFVGCLAGYXAYRVSNDKRDV

SEQ ID NO: 1380 - protein, 68 aa, Homo sapiens
  SIGNAL -19..-1
MEGVAXXTFLAAXRRLVTGQTSPRGTWCLYPGFCRSVACAMPCCSHRSCREDPGTSESREMVRVRDHG

SEQ ID NO: 1381 - protein, 37 aa, Homo sapiens [sequence omitted]

SEQ ID NO: 1382 - protein, 24 aa, Homo sapiens [sequence omitted]

SEQ ID NO: 1383 - protein, 26 aa, Homo sapiens
  SIGNAL -20..-1
MGRTREAGCVAAGVVIGAGAATVYTD

SEQ ID NO: 1384 - protein, 60 aa, Homo sapiens
  SIGNAL -38..-1
MESHSVAQARMRXXNLSSLQPLPPGFKPXSCLSLLSNXDYRHAPPFLANFXIFHRDGVSP

SEQ ID NO: 1385 - protein, 61 aa, Homo sapiens
  SIGNAL -55..-1
MFHGIPATPGIGAPGNKPELYEVRQHGRAVCGGEDNASPGEGLHQGLCLPQRVHCSLLPAP

SEQ ID NO: 1386 - protein, 25 aa, Homo sapiens
  SIGNAL -22..-1
MPHSFVSCNLFLSVLNFLFLLSFST

SEQ ID NO: 1387 - protein, 30 aa, Homo sapiens
  SIGNAL -26..-1
MAVFLQKRKHTMRHHLLLSTLATIAGNIYR

SEQ ID NO: 1388 - protein, 47 aa, Homo sapiens
  SIGNAL -26..-1
MADSEALPSLAGDPVAVEALLRAVFGVVVDEAIQKGTSVSQKVCXWK

SEQ ID NO: 1389 - protein, 87 aa, Homo sapiens
  SIGNAL -36..-1
MRLAMVQLVLNNLKTFYPFADHDLAELPVSSPLCHAVLKTLQCWEQVLLRRLEIHGGPPQNYIASHTAXXSLSAGPAILRHKALLEP

SEQ ID NO: 1390 - protein, 51 aa, Homo sapiens
  SIGNAL -20..-1
MFKLFLFLFILXYFXXYTLSSGIYVQNVQVCYIGIHMPWWFAAPMNLSSAL

SEQ ID NO: 1391 - protein, 29 aa, Homo sapiens [sequence omitted]

SEQ ID NO: 1392 - protein, 18 aa, Homo sapiens [sequence omitted]

SEQ ID NO: 1393 - protein, 53 aa, Homo sapiens
  SIGNAL -25..-1
MHKFFRHFYSDFLIYFFQLHSCCHDKVTAXRAYXHYSSLLTPYLSQHPCPHPG

SEQ ID NO: 1394 - protein, 121 aa, Homo sapiens
  SIGNAL -26..-1
MAALGSPSHTFRGLLRELRYLSAATGHPIATPRPIGTXVKAFRAHRVTSEKLCRAQHELHFQAATYLCLLRXSGNMWPYIRNFMARVSARWRSLLAWWVSSCPISLEGRAGSHEHGEYPWM

SEQ ID NO: 1395 - protein, 30 aa, Homo sapiens
  SIGNAL -28..-1
MITDVQLAIFANMLGVSLFLLVVLYHYAAV

SEQ ID NO: 1396 - protein, 25 aa, Homo sapiens
  SIGNAL -18..-1
MAEGALSFLCSLSQNALNISLISRK

SEQ ID NO: 1397 - protein, 23 aa, Homo sapiens [sequence omitted]

SEQ ID NO: 1398 - protein, 19 aa, Homo sapiens
  SIGNAL -15..-1
MESCTVGCATASSWGCTSR

SEQ ID NO: 1399 - protein, 71 aa, Homo sapiens
  SIGNAL -43..-1
MAMSFEWPWQYRFPPFFTLQPNVDTRQKQLAAWCSLVLSFCRLHKQSSMTVMEAQESPLFNNVKLQRKLPV

SEQ ID NO: 1400 - protein, 23 aa, Homo sapiens [sequence omitted]

SEQ ID NO: 1401 - protein, 28 aa, Homo sapiens
  SIGNAL -26..-1
MLHFXYMIXVCLERMCILQLLSAVLYRF

SEQ ID NO: 1402 - protein, 35 aa, Homo sapiens
  SIGNAL -30..-1
MSSEPPPPPQPPTHQASVGLLDTPLGAVSAHHPLC

SEQ ID NO: 1403 - protein, 29 aa, Homo sapiens [sequence omitted]

SEQ ID NO: 1404 - protein, 26 aa, Homo sapiens
  SIGNAL -19..-1
MREKPQPALLTSSELPALASQIHCRV

SEQ ID NO: 1405 - protein, 38 aa, Homo sapiens
  SIGNAL -26..-1
MPHNHLEGDALLRVPVLCIWRAWLRAEVGGRAPLPGRM

SEQ ID NO: 1406 - protein, 27 aa, Homo sapiens
  SIGNAL -22..-1
MKNTLYYNFCLFWIXLPPHTCTHTDTH

SEQ ID NO: 1407 - protein, 53 aa, Homo sapiens
  SIGNAL -35..-1
MCLNPACSGPLSLRSPRLPPLFCTFLSLSLHPWGGFFLCAWISXFLPWVCVXA

SEQ ID NO: 1408 - protein, 101 aa, Homo sapiens
  SIGNAL -89..-1
MAHSKTRTNDGKITYPPGVKEISDKISKEEMVRRLKMVVKTFMDMDQDSEEEKELYLNLALHLASDFFLKHPDKDVRLLVACCLADIFRIYAPEAPYTSPK

SEQ ID NO: 1409 - protein, 26 aa, Homo sapiens
  SIGNAL -18..-1
MXSCEIAWTATPSSAAFAQAFPTACN

SEQ ID NO: 1410 - protein, 46 aa, Homo sapiens [sequence omitted]

SEQ ID NO: 1411 - protein, 29 aa, Homo sapiens
  SIGNAL -27..-1
MXSHRLFGCFPSDLSRMVLLSSALLSTEN

SEQ ID NO: 1412 - protein, 47 aa, Homo sapiens
  SIGNAL -21..-1
MRPSHSSAYLCLHLCAFSTEGWMNRLSSSLRLAPLPLYPFCLPSNSP

SEQ ID NO: 1413 - protein, 123 aa, Homo sapiens
  SIGNAL -16..-1
MWSRLVWLGLRAPLGGRQGFTSKADPQGSGRITAAVIEHLERLALVDFGSREAVARLEKAIAFADRLRAVDTDGVEPMESVLEDRCLYLRSDNVVEGNCADELLQNSHRVVEEYFVAPPGNIS

SEQ ID NO: 1414 - protein, 83 aa, Homo sapiens
  SIGNAL -81..-1
MAPPVRYCIPGERLCNLEEGSPGSGTYTRHGYIFSSLXGCLMKSSENGALPVVSVVRETESQLLPDVGAIVTCKSLASIHALP

SEQ ID NO: 1415 - protein, 80 aa, Homo sapiens
  SIGNAL -60..-1
MVGNQGPQPPPFPMEPTMAQYQAISKHLPKVCQEPHLPRGHLQPQQHRLLVARLHMASLARRCTEWAKLHCSDARLPWVS

SEQ ID NO: 1416 - protein, 35 aa, Homo sapiens
  SIGNAL -28..-1
MKPQTLAVSVTVLKDGVAGVCFFRRSDASEVSSFW

SEQ ID NO: 1417 - protein, 47 aa, Homo sapiens
  SIGNAL -43..-1
MVVLICLSLMISNTELFFIRFLTACMPSFEKCLFLSFAHFLMGRTHR

SEQ ID NO: 1418 - protein, 36 aa, Homo sapiens
  SIGNAL -22..-1
MSSLYILDISLLSDILFANIFSHSWDVFPLSFLFFS

SEQ ID NO: 1419 - protein, 95 aa, Homo sapiens
  SIGNAL -84..-1
MGQGARGWHREPGLGLRHSPRRLSGALHLEAGCDRNATTVRPLRAKXGDALPEEIREPALRDAQWVRDQLASSLLIILLPNTQDLRIQKDPTPGP

SEQ ID NO: 1420 - protein, 87 aa, Homo sapiens
  SIGNAL -48..-1
MRKRKISVCQQTWALLCKNFLKKWRMKRESLMEWLNSLLLLLCLYIYPHSHQVNXXSSLLTMDLGRVDXXNESRFSVVYTPVTNTTP

SEQ ID NO: 1421 - protein, 33 aa, Homo sapiens
  SIGNAL -30..-1
MCTCLCVCLYMYNMQFLXFVFVCXLLKCMSVPL

SEQ ID NO: 1422 - protein, 119 aa, Homo sapiens
  SIGNAL -31..-1
MAASAAAAELQASGGPRHPVCLLVLGMAGSGKTTFVQRLTGHLHAQGTPPYVINLDPAVHEVPXPANIDIRDTVKYKEVMKQYGLGPNGGIVTSLNLFXTRFDQVMKLLRRPRTCPNMC

SEQ ID NO: 1423 - protein, 38 aa, Homo sapiens [sequence omitted]

SEQ ID NO: 1424 - protein, 45 aa, Homo sapiens
  SIGNAL -24..-1
MGFLGSPRQRNSMCLLLDVSSXKSTDNXXXXXLIIYYLITRKGPG

SEQ ID NO: 1425 - protein, 51 aa, Homo sapiens
  SIGNAL -43..-1
MSCQXXLAXTLTWLMIRGRHPYLTRRSARNFNIFLAAPSPVWQPQRTRRPQ

SEQ ID NO: 1426 - protein, 51 aa, Homo sapiens
  SIGNAL -34..-1
MCPAWLPCWTAQTEHLDRYRKFHQMALXPGTSRAQALLYNEVLERFMFTRL

SEQ ID NO: 1427 - protein, 44 aa, Homo sapiens [sequence omitted]

SEQ ID NO: 1428 - protein, 162 aa, Homo sapiens
  SIGNAL -121..-1
MVVFGYEAGTKPRDSGVVPVGTEEAPKVFKMAASMHGQPSPSLEDAKLRRPMVIEIIEKNFDYLRKEMTQNIYQMATFGTTAGFSGIFSNFLFRRCFKVKHDALKTYASLATLPFLSTVVTDKLFVIDALYSDNISKENCVFRSSLIGIVCGVFYPSSXAFT

SEQ ID NO: 1429 - protein, 63 aa, Homo sapiens
  SIGNAL -38..-1
MAEITNIRPSFDVSPVVAGLIGASVLVVCVSVTVFVWSCCXQQAEKKHKNPPYKFIHMLKGXS

SEQ ID NO: 1430 - protein, 25 aa, Homo sapiens
  SIGNAL -15..-1
MVILTMLILLIHEHGIFFSLVCVLF

SEQ ID NO: 1431 - protein, 33 aa, Homo sapiens
  SIGNAL -29..-1
MFSHNHSYTYTPQHSPLTHTHTCTPPSTAHPRG

SEQ ID NO: 1432 - protein, 22 aa, Homo sapiens
  SIGNAL -15..-1
MFXMILLCFLAVSNFNKLLWGX

SEQ ID NO: 1433 - protein, 31 aa, Homo sapiens
  SIGNAL -26..-1
MFLILGKFSRVMGLPLACFSLFGXLPQGLLI

SEQ ID NO: 1434 - protein, 30 aa, Homo sapiens
  SIGNAL -19..-1
MVALGQLAXLPGXXHGGLSAVTVVLPILLC

SEQ ID NO: 1435 - protein, 22 aa, Homo sapiens
  SIGNAL -15..-1
MPVSFVCLLFRNVYSNLLPSFF

SEQ ID NO: 1436 - protein, 64 aa, Homo sapiens [sequence omitted]

SEQ ID NO: 1437 - protein, 43 aa, Homo sapiens
  SIGNAL -25..-1
MAVGGTAVITRRLLGRSGFSFQVSGWGWGERVDDFLFSSGIDG

SEQ ID NO: 1438 - protein, 34 aa, Homo sapiens
  SIGNAL -21..-1
MRHHVRXPALSSLAHHPRTSGQKREPIAPAQLSP

SEQ ID NO: 1439 - protein, 115 aa, Homo sapiens
  SIGNAL -73..-1
MLILNGFRGHATDSVKNSMESMNTDMVIIPGGLTSQLQVLDVVVYKPLNDSVRAQYSNWLLAGNLALSPTGNAKKPPLGLFLEWVMVAWNSISSESIVQGXKEVPYLXQLGGGRR

SEQ ID NO: 1440 - protein, 34 aa, Homo sapiens
  SIGNAL -25..-1
MICTTVYITMAPYCLSNCLLXXSWGLHLYRFLAP

SEQ ID NO: 1441 - protein, 16 aa, Homo sapiens [sequence omitted]

SEQ ID NO: 1442 - protein, 28 aa, Homo sapiens
  SIGNAL -24..-1
MLSIFSFFCRPFVYLLLRNLXSYSLPTT

SEQ ID NO: 1443 - protein, 94 aa, Homo sapiens
  SIGNAL -77..-1
MFPVSSGCFQEQQETNKSLPRSASTPETRTKFTQDNLCXAQRERLDSANLWVLVDCILRDTSEDLGLQCDAVNLAFGRRCEELEDARHKLQXHL

SEQ ID NO: 1444 - protein, 20 aa, Homo sapiens
  SIGNAL -15..-1
MPLVHSFLWLSSILYIYHLR

SEQ ID NO: 1445 - protein, 56 aa, Homo sapiens
  SIGNAL -24..-1
MISNGKFFCFFXVFXFXFLXRXLXXXPRLECNGKXSAHXNLRLLSXSNSLASAPRG

SEQ ID NO: 1446 - protein, 101 aa, Homo sapiens
  SIGNAL -90..-1
MEDSASASLSSAAATGTSTSTPAAPTARKQLDKEQVRKAVDALLTHCKSRKNNYGLLLNENESLFLMVVLWKIPSKELRVRLTLPHSIRSDSEDICXFTKD

SEQ ID NO: 1447 - protein, 59 aa, Homo sapiens
  SIGNAL -29..-1
MNAEGASPGKETNTGTLIELNLXSPVALQWPLSSPSCLRILSNKVPRNLRWQKHYSTHQ

SEQ ID NO: 1448 - protein, 81 aa, Homo sapiens
  SIGNAL -63..-1
MLGLDELGRSGCGHCTQADLRFGDAAGXEPRXRXTHRNTAAARVPPPPRVMAAAAALRAPAQSSVTFEDVAVNFSLEEWSL

SEQ ID NO: 1449 - protein, 49 aa, Homo sapiens
  SIGNAL -26..-1
MSALKDFREFLNWWGNLSFHLQEAHGSEIAEMGAGILEEKNYGQQXHCN

SEQ ID NO: 1450 - protein, 36 aa, Homo sapiens
  SIGNAL -30..-1
MSLPPFFHPSPAPSLAPPPSLFLSLPPSLSPPLPAR

SEQ ID NO: 1451 - protein, 18 aa, Homo sapiens
  SIGNAL -13..-1
MFFLCGFLYLCFISFFFF

SEQ ID NO: 1452 - protein, 51 aa, Homo sapiens
  SIGNAL -42..-1
MKAGPCSCQEGGRQWAHGSVPLQPTARLAALGIFLCPGETLSASLHWNPIG

SEQ ID NO: 1453 - protein, 53 aa, Homo sapiens
  SIGNAL -23..-1
MLSQSFQKNKTNLLCLTFQRCQSYNWLNIFEATYMTTLFISVIXTNFLKRYLL

SEQ ID NO: 1454 - protein, 31 aa, Homo sapiens [sequence omitted]

SEQ ID NO: 1455 - protein, 47 aa, Homo sapiens [sequence omitted]

SEQ ID NO: 1456 - protein, 35 aa, Homo sapiens
  SIGNAL -31..-1
MHEYLPRNFHDFNSPNSKLGMGMGFFSGVKSWIGG

SEQ ID NO: 1457 - protein, 83 aa, Homo sapiens
  SIGNAL -36..-1
MASXVPVKDKKLLEVKLGELPSWILMRDFSPSGIFGAFQRGYYRYYNKYINVKKGSISGITMVLACYVLFSYSFSYKHLKHES

SEQ ID NO: 1458 - protein, 24 aa, Homo sapiens
  SIGNAL -18..-1
MVISAGALLWMAWDGQLSRPEGAR

SEQ ID NO: 1459 - protein, 31 aa, Homo sapiens
  SIGNAL -18..-1
MVHCNLELLGSSYNPISASPVARTISCPAIV

SEQ ID NO: 1460 - protein, 127 aa, Homo sapiens
  SIGNAL -88..-1
MLGSGFKAERLRVNLRLVINRLKLLEKKKTELAQKARKEIADYLAAGKDERARIRVEHIIREDYLVEAMEILELYCDLLLARFGLIQSMKELDSGLAESVSTLIWAAPRLQSEVAELKIVADQLCPS

SEQ ID NO: 1461 - protein, 54 aa, Homo sapiens
  SIGNAL -43..-1
MRGWXAPAWRXLXTRRLPMGSRHGASPASAVWCLXLKLVPALCISGLTLGIQGF

SEQ ID NO: 1462 - protein, 49 aa, Homo sapiens
  SIGNAL -34..-1
MYFKTTTXXHSAHMLLQICFFRLTILXFHDNTWGSTSFSXVAAMLFHYR

SEQ ID NO: 1463 - protein, 26 aa, Homo sapiens
  SIGNAL -24..-1
MSSNIQRLGFPLLFLFFLFLFFFFFF

SEQ ID NO: 1464 - protein, 69 aa, Homo sapiens
  SIGNAL -67..-1
MCDAFVGTWKLVSSENFDDYMKEVGVGFATRKVAGMAKPNMIISVNGDVITIPHLVLPLPMLPTSNRKR

SEQ ID NO: 1465 - protein, 35 aa, Homo sapiens
  SIGNAL -21..-1
MFLYRSFGGQLLSFLLGTYLGRREVAGPQHGQFSK

SEQ ID NO: 1466 - protein, 19 aa, Homo sapiens
  SIGNAL -16..-1
MXGFFCLCAFNSFLLSPEG

SEQ ID NO: 1467 - protein, 68 aa, Homo sapiens
  SIGNAL -66..-1
MIFPHCMYCLECITKNGLLGLKVLPLYGIMLIFFPKVVYNNQPLHYKSVMVFQLTSFLSIXIFVNPTR

SEQ ID NO: 1468 - protein, 79 aa, Homo sapiens
  SIGNAL -54..-1
MVSMSFKRNRSDRFYSTRCCGCCHVRXGTIILGTWYMVVNLLMAXLLTVEVTHPNSMPAVNIQYEVIGNYYSSERMADN

SEQ ID NO: 1469 - protein, 94 aa, Homo sapiens
  SIGNAL -31..-1
MAAATLTSKLYSLLFRRTSTFALTIXRXXSCSSXAPSIKARTLSTTTSTRGSCGNTSSTSMRTSSSLEAPIQARRTRSTQQLFAQSWSLSXKMM

SEQ ID NO: 1470 - protein, 83 aa, Homo sapiens
  SIGNAL -41..-1
MKAIKKSLTEEEYLYLDFSHQTEGCIFPLHTSVTLFLLSYCDCKIFKICLVVTKEVSRDXSLLRDDLIQDVEIQIISRQELPP

SEQ ID NO: 1471 - protein, 20 aa, Homo sapiens
  SIGNAL -14..-1
MFLCVCYFIRKSTSFFSISS

SEQ ID NO: 1472 - protein, 71 aa, Homo sapiens [sequence omitted]

SEQ ID NO: 1473 - protein, 18 aa, Homo sapiens [sequence omitted]

SEQ ID NO: 1474 - protein, 47 aa, Homo sapiens
  SIGNAL -37..-1
MEVLSXPNSFQTQALWDSLHSPGVPGSGLCSMAAVQAGNQAIYSASG

SEQ ID NO: 1475 - protein, 47 aa, Homo sapiens
  SIGNAL -42..-1
MQATASQPIHFFXSSPQAPRHHSGHPVPLLLTQAGFPRRGEAAPPLL

SEQ ID NO: 1476 - protein, 34 aa, Homo sapiens
  SIGNAL -30..-1
MRGXNXVFRVFSESLKGLCTFTLNLTAVRTIXLD

SEQ ID NO: 1477 - protein, 40 aa, Homo sapiens
  SIGNAL -32..-1
MGRIIPMVEKADTAQKFQGRLTISTXLSTSXXFMELSSLR

SEQ ID NO: 1478 - protein, 112 aa, Homo sapiens
  SIGNAL -67..-1
MNLVICVLLLSIWKNNCMTTNQTNGSSTTGDKPVESMQTKLNYLRRNLLILVGIIIMVFVFICFCYLHYNCLSDDASKAGMVKKKGIAAKSSKTSFSEAKTASQCSSETQTG

SEQ ID NO: 1479 - protein, 35 aa, Homo sapiens [sequence omitted]

SEQ ID NO: 1480 - protein, 72 aa, Homo sapiens
  SIGNAL -52..-1
MIFEPVVLKPVFLNIFFFSHHVFTVFFSGSHVDILSRTVLVWDCLLPPPSFFLLLLSSSXSXLLLXXSSSSR

SEQ ID NO: 1481 - protein, 20 aa, Homo sapiens
  SIGNAL -14..-1
MLVPLLSHLLFKFTWPKXSQ

SEQ ID NO: 1482 - protein, 70 aa, Homo sapiens
  SIGNAL -49..-1
MDRNPSPPPPGRDKEEEEEVAGGDCIGSTVYSKHWLFGVLSGLXQXVSPGKHQNLGSXXEEQLTELDERN

SEQ ID NO: 1483 - protein, 37 aa, Homo sapiens
  SIGNAL -23..-1
MKLSLAGYEILGCHFFSLALLNTGPQYLLAYRVSAER

SEQ ID NO: 1484 - protein, 48 aa, Homo sapiens
  SIGNAL -40..-1
MATSVGHRCLGLLHGVAPWRSSLHPCEITALSQSLQPLRKLPFRASXT

SEQ ID NO: 1485 - protein, 126 aa, Homo sapiens
  SIGNAL -49..-1
MAPKGKVGTRGKKQIFEENRETLKFYLRIILGANAIYCLVTLVFFYSSASFWAWLALGFSLAVYGASYHSMSSMARAAFSEDGALMDGGMDLNMEQGMAEHLKDVILLTAIVQVLSCFSLYVWSFW

SEQ ID NO: 1486 - protein, 55 aa, Homo sapiens
  SIGNAL -29..-1
MAAVTVTVTKTAAAATAFNKAVWFTPCSCQEVSSRLPARTAATRQDRADKKERPC

SEQ ID NO: 1487 - protein, 34 aa, Homo sapiens
  SIGNAL -19..-1
MLQFEKPGSAICLWHSTLGGXGGREIXSLRPACG

SEQ ID NO: 1488 - protein, 24 aa, Homo sapiens [sequence omitted]

SEQ ID NO: 1489 - protein, 76 aa, Homo sapiens
  SIGNAL -15..-1
MKLQTLAFWSAYVPCQTQDRDAPRLTLEQIDLIRRMCASYSELELVTSAKALNDTQKLACLIGVEGGHSLDNSLSR

SEQ ID NO: 1490 - protein, 23 aa, Homo sapiens
  SIGNAL -14..-1
MPACLSSFVIPSLLSPSSPPSIG

SEQ ID NO: 1491 - protein, 34 aa, Homo sapiens
  SIGNAL -16..-1
MVVSFAGSCTILGASSHSFPIEVSLFPVDCGFLL

SEQ ID NO: 1492 - protein, 32 aa, Homo sapiens
  SIGNAL -20..-1
MCCPGWNAVSQSWLAAPSTSWVQEILVLQPPG

SEQ ID NO: 1493 - protein, 69 aa, Homo sapiens
  SIGNAL -54..-1
MGEIKVSPDYNWFRGTVPLKXXXVDDDDSKIWSXYDAGPRSIRCPLIFLXXVSGTXDVFFRQILALTGW

SEQ ID NO: 1494 - protein, 45 aa, Homo sapiens
  SIGNAL -16..-1
MDASHSHLSLVGHSRACGVTSRPHARHRGRCLGPCSRSGPRLCSA

SEQ ID NO: 1495 - protein, 61 aa, Homo sapiens
  SIGNAL -34..-1
MGSNAVVWHTKPSLLNHPASSLISHDPWPRGAFALSCPSASFMLFSSLQCPFPYXXTECNX

SEQ ID NO: 1496 - protein, 56 aa, Homo sapiens
  SIGNAL -18..-1
MKEDGACLFRAVADQVYGDQDMHEVVRKHXMDYLMKNADYFSXYVTEDFTTYIXRK

SEQ ID NO: 1497 - protein, 24 aa, Homo sapiens
  SIGNAL -21..-1
MVHLILTEVLIMIXEAXNVWCGDS

SEQ ID NO: 1498 - protein, 51 aa, Homo sapiens
  SIGNAL -47..-1
MYHNLFALLLIDIHVVLVFYCLDLLMIHIFYCKYCLXFGILASEVYSWNIY

SEQ ID NO: 1499 - protein, 44 aa, Homo sapiens
  SIGNAL -29..-1
MESPSRAGGVXLXKAASPLCSXSSGYCXAFPRRSARRHLHPGHG

SEQ ID NO: 1500 - protein, 61 aa, Homo sapiens [sequence omitted]

SEQ ID NO: 1501 - protein, 33 aa, Homo sapiens
  SIGNAL -30..-1
MDVSCKILYNVIEKFCNNLLKLSSHSPTCACKL

SEQ ID NO: 1502 - protein, 29 aa, Homo sapiens
  SIGNAL -20..-1
MIFKDVFSHLSGSSLQLCVAQFLXLSAVD

SEQ ID NO: 1503 - protein, 50 aa, Homo sapiens
  SIGNAL -44..-1
MKLTKNILXVIIGCFKLIAYKNSVLYFYSNFSFSFLFFFFLSFFFFFFFF

SEQ ID NO: 1504 - protein, 92 aa, Homo sapiens
  SIGNAL -87..-1
MNNQKQXXPTLSGQRFKTRKRDEKERFDPTQFQDCIIQGLTETGTDLEAVAKFLDASGAKLDYRRYAETLFDILVAGXMLAPGGTLADDMMX

SEQ ID NO: 1505 - protein, 35 aa, Homo sapiens
  SIGNAL -17..-1
MADSLEIKLPFLPFAQQIDIKSCFYFFFXNXXFPR

SEQ ID NO: 1506 - protein, 115 aa, Homo sapiens
  SIGNAL -35..-1
MDRKWTWKRGQRSHLESGQAAPATAAATAASATTGASVWRSTMGXLCDCTXXPYEGPFCKKEVSAVFEAGTSVTYMFQEPYPVTKNISLSSSAIYTDSAPSKENIALSFVTTQAP

SEQ ID NO: 1507 - protein, 74 aa, Homo sapiens
  SIGNAL -43..-1
MAPQMYEFHLPLSPEELLKSGGVNQYVVQEVLSIKHLPPQLRAFQAAFRAQGPLAMLQHFDTIYSILHHFRSID

SEQ ID NO: 1508 - protein, 84 aa, Homo sapiens
  SIGNAL -15..-1
MAAVQVVGSWPSVQPREAPREAIPERGNGFRLLSARLCALRPDDSSSARTEIHLXFDQLISENYSEGSGVAPEDVSALLVQACG

SEQ ID NO: 1509 - protein, 48 aa, Homo sapiens
  SIGNAL -30..-1
MFHGCHILSFLRISTRGFLFFLQFSFPLYYLFRXXFPQSFMLEAFVRC

SEQ ID NO: 1510 - protein, 42 aa, Homo sapiens
  SIGNAL -26..-1
MYRHSKQRNNVPCLVLYAPWVPPLLLAFWGWWLLEQGLFFFF

SEQ ID NO: 1511 - protein, 137 aa, Homo sapiens
  SIGNAL -50..-1
MGDPSKQDILTIFKRLRSVPTNKVCFDCGAKNPSWASITYGVFLCIDCSGSHRSLGVHLSFIRSTELDSNWSWFQLRCMQVGGNASASSFFHQHGCSTNDTNAKYNSRAAQLYREKIKSLASQATRKHGTDLWLDSC

SEQ ID NO: 1512 - protein, 26 aa, Homo sapiens
  SIGNAL -22..-1
MPLPPNQSPLLLHLVFHQRTLISLPP

SEQ ID NO: 1513 - protein, 21 aa, Homo sapiens
  SIGNAL -13..-1
MFLTFFFCTQVHGPSILDSPA

SEQ ID NO: 1514 - protein, 56 aa, Homo sapiens
  SIGNAL -14..-1
MVTLWIFQFFLCLTCKAYNLRNCNDGKGXXSXVLGLEQXLPESAGMVXFLGLKHRW

SEQ ID NO: 1515 - protein, 37 aa, Homo sapiens
  SIGNAL -14..-1
MVLWAGPXVPLLCAAXGLGALHPRCSSQGLRLAXSEA

SEQ ID NO: 1516 - protein, 61 aa, Homo sapiens
  SIGNAL -41..-1
MNWRRKSVIGLSFDFVALNLTGFVAYSVFNIGLLWVPXXXGAVSPQIPQRSEPREQQRRLL

SEQ ID NO: 1517 - protein, 149 aa, Homo sapiens
MEPLAAYPLKCSGPRAKVFAVLLSIVLCTVTLFLLQLKXLKPKINSFYAFEVKDAKGRTVSLEKYKGKVSLVVNVASDCQLTDRNYLGLKELHKEFGPSHFSVLAFPCNQFGESEPRPSKEVESFARKNYGVTFPIFHKIKILGSEGEL

SEQ ID NO: 1518 - protein, 132 aa, Homo sapiens
MNEAMATDSPRRPSRCTGGVVVRPQAVTEQSYMESVVTFLQDVVPQAYSGTPLTEEKEKIVWVRFENADLNDTSRNLEFHEIHSTGSEPPLLIMIGYSDGMQVWSIPIXGEXKSSSLFDMAQFERLESCLLH

SEQ ID NO: 1519 - protein, 46 aa, Homo sapiens
MPVTRASQPRKPSSAQQQKAALLXNNTALQSVSLRSKTTIRERPSS

SEQ ID NO: 1520 - protein, 41 aa, Homo sapiens
MNGFGRLEHFSGAVYEGQFKDNMFHGLGTYTFPNGAKYTGI

SEQ ID NO: 1521 - protein, 131 aa, Homo sapiens
MAKIAKTHEDIEAQIREIQGKKAALDEAQGVGLDSTGYYDQEIYGGSDSRFAGYVTSIAATELEDDDDDYSSSTSLLGQKKPGYHAPVALLNDIPQSTEQYDPFAEHRPPKIADREDEYKKHRRTMIISQS

SEQ ID NO: 1522 - protein, 82 aa, Homo sapiens
MPINKSEKPESCDNVKVVVRCRPLNEREKSMCYKQAVSVDEMRGTITVHKTDSSNEPPKTFTFDTVFGPESKQLDVYNLTAR

SEQ ID NO: 1523 - protein, 40 aa, Homo sapiens
MPNRGGNGLAPGEDRFKPVVPWPHVEGVEVDLESIRRINK

SEQ ID NO: 1524 - protein, 35 aa, Homo sapiens
MSLWLCFQCPLGVSKSNKKRINLCNGFWNEKIKNR

SEQ ID NO: 1525 - protein, 47 aa, Homo sapiens
MGTHVFAINKRTYVISRDRELSTAKPXCSSLLTAPVLCYWRACPLQT

SEQ ID NO: 1526 - protein, 56 aa, Homo sapiens [sequence omitted]

SEQ ID NO: 1527 - protein, 55 aa, Homo sapiens
MTTTSKHAAYCLKGSCLXQARVQWPLKXTTASNFWAQVILSLPVVFVDCLMEXHG

SEQ ID NO: 1528 - protein, 121 aa, Homo sapiens
MEGGGGIPLETLKEESQSRHVLPASFEVNSLQKSNWGFLLTGLVGGTLVAVYAVATPFVTPALRKVCLPFVPATMKQIENVVKMLRCRRGSLVDIGSGDGRIVIAAAKKGFXAVGYELNPW

SEQ ID NO: 1529 - protein, 154 aa, Homo sapiens
MATPLAVNSAASLWGPYKDIWHKVGNALWRRQPEAVXLLDKILKKHKPDFISLFKNPPKNVQQHEKVQKASTEGVAIQGQQGTRLLPEQLIKEAFILSDLFDIGELAAVELLLAGEHQQPHFPGLTRGLVAVLLYWDGKRCIANSLKALIQSRR

SEQ ID NO: 1530 - protein, 125 aa, Homo sapiens
MNGRADFREPNAEVPRPIPHIGPDYIPTEEERRVFAECNDESFWFRSVPLAATSMLITQGLISKGILSSHPKYGSIPKLILACIMGYFAGKLSYVKTCQEKFKKLENSPLGEALRSGQARRSSPP

SEQ ID NO: 1531 - protein, 35 aa, Homo sapiens
MHMSKLINLYTSXMCNLLXIHLXXISCLXNNKXTL

SEQ ID NO: 1532 - protein, 111 aa, Homo sapiens
MYGKGKSNSSAVPSDSQAREKLALYVYEYLLHVGAQKSAQTFLSEIRWEKNITLGEPPGFLHSWWCVFWDLYCAAPERRETCEHSSEAKAFHDYSAAAAPSPVLGNIPPGD

SEQ ID NO: 1533 - protein, 107 aa, Homo sapiens
MNPEYDYLFKLLLIGDSGVGKSCLLLRFADDTYTESYISTIGVDFKIRTIELDGKTIKLQIWDTAGQERFRTITSSYYRGAHGIIVVYDVTDQESYAXVKQWLQEID

SEQ ID NO: 1534 - protein, 31 aa, Homo sapiens
MNSKAXKSSTANQGDGDEEXVGRXEXSVGEF

SEQ ID NO: 1535 - protein, 48 aa, Homo sapiens
MLYSTLKHTLQYVIINCGHHAVQKISKTYSSCLTEXLYPLPNISPIPP

SEQ ID NO: 1536 - protein, 94 aa, Homo sapiens
MNDEVNPRRVLELMGSEVTQIACGRQHTLXFVPSSGLIYAFGCGARGQLGTGHTCNVKCPSPVKGYWAAHSGQLSARADRFKYHIVKQIFSGGD

SEQ ID NO: 1537 - protein, 22 aa, Homo sapiens
MPVRTITRQNGSVPWGPNHCDK

SEQ ID NO: 1538 - protein, 94 aa, Homo sapiens
MGDNPFQPKSNSKMAELFMECEEEELEPWQKKVKEVEDDDDDEPIFVGEISSSKPAISNILNRVNPSSYSRGLKNGALSRGITAAFKPTSQHYT

SEQ ID NO: 1539 - protein, 67 aa, Homo sapiens
MVTQAQQEITVQQLMAHLDAIRKDMVILEKSEFANLRAENEKMKIELDQVKQQLMHETSXIRADNKL

SEQ ID NO: 1540 - protein, 38 aa, Homo sapiens
MKFGNVRMXSIQIFIVSIWSFFLFYGKYTYIRLILSQG

SEQ ID NO: 1541 - protein, 35 aa, Homo sapiens
MTFDLSVFSTLSDHFYSSSLSNTARNLYICLFHIT

SEQ ID NO: 1542 - protein, 28 aa, Homo sapiens
MGRWALDVAFLWKAVLTLGLVLLYYCFS

SEQ ID NO: 1543 - protein, 128 aa, Homo sapiens
MALHVPKAPGFAQMLKEGAKHFSGLEEAVYRNIQACKELAQTTRTAYGPNGMNKMVINHLEKLFVTNDAATILRELEVQHPAAKMIVMASHMQEQEVGDGTNFVLVFAGALLELAEELLRIGLSVSEV

SEQ ID NO: 1544 - protein, 33 aa, Homo sapiens
MANRYTMDLTAIYESLLSLSPDVTLTHFAHCNL

SEQ ID NO: 1545 - protein, 68 aa, Homo sapiens
MMEESGIETTPPGTPPPNPAGLAATAMSSTPVPLAATSSFSSPNVSSMESFPPLAYSTPQPPLPPVRP

SEQ ID NO: 1546 - protein, 50 aa, Homo sapiens
MLCLTEGAKDECNVVEVVARNHDHQEIAVPVAXLKLSCQPMLSLDDFQLQ

SEQ ID NO: 1547 - protein, 139 aa, Homo sapiens
MPTVSVKRDLLFQALGRTYTDEEFDELCFEFGLELDEITSEKEIISKEQGNVKAAGASDVVLYKIDVPANRYDLLCLEGLVRGLQVFKERIKAPVYKRVMPDGKIQKLIITEETAKIRPFAVAAVLRNIKFTKDRYDSF

SEQ ID NO: 1548 - protein, 71 aa, Homo sapiens
MFSEELWLENEKKCAVVRKSKQGRKRQELLAVAFGVKVHTFRGPHWCEYCANFMWGLIAQGVRCSDCGLNV

SEQ ID NO: 1549 - protein, 29 aa, Homo sapiens [sequence omitted]

SEQ ID NO: 1550 - protein, 50 aa, Homo sapiens
MQELFLKFVDENWEGSLKSKYVRGSDPVLKLLDDNGNIAEELSILKWTQT

SEQ ID NO: 1551 - protein, 68 aa, Homo sapiens
MPKTMHFLFRFIVFFYLWGLFTAQRQKKEESTEEVKIEVLHRPENCSKTSKKGDLLNAHYDGYLAKDG

SEQ ID NO: 1552 - protein, 52 aa, Homo sapiens
MLEELKAGQELEEQTISHGFARGVRRGVAIVGKGLEWHGCWWMCHGYRILAG

SEQ ID NO: 1553 - protein, 37 aa, Homo sapiens
MRLGSSKLKSNQLLQEALSRMKWGGPSFQPRKPTVPG

SEQ ID NO: 1554 - protein, 57 aa, Homo sapiens
  SIGNAL -13..-1
MLLLLLLLPLALGDKGDGGRQTIWGWLLAASAGAGDGAGGPVCPCALLLLLPPGWLD

SEQ ID NO: 1555 - protein, 95 aa, Homo sapiens
  SIGNAL -18..-1
MKLLMVLMLAALLLHCYADSGCKLLEDMVEKTINSDISIPEYKELLQEFIDSDAAAEAMGKFKQCFLNQSHRTLKNFGLMMHTVYDSIWCNMKSN

SEQ ID NO: 1556 - protein, 95 aa, Homo sapiens
  SIGNAL -31..-1
MVAMAAGPSGCLVPAFGLRLLLATVLQAVSAFGAEFSSEACRELGFSSNLLCSSCDLLGQFNLLQLDPDCRGCCQEEAQFETKKLYAGAILEVCG

SEQ ID NO: 1557 - protein, 101 aa, Homo sapiens
  SIGNAL -32..-1
MFAPAVMRAFRKNKTLGYGVPMLLLIVGGSFGLREFSQIRYDAVKSKMDPELEKKLKENKISLESEYEKIKDSKFDDWKNIRGPRPWEDPDLLQGKKSRKP

SEQ ID NO: 1558 - protein, 115 aa, Homo sapiens
  SIGNAL -51..-1
MQAQAPVVVVTQPGVGPGPAPQNSNWQTGMCDCFSDCGVCLCGTFCFPCLGCQVAADMNECCLCGTSVAMRTLYRTRYGIPGSICDDYMATLCCPHCTLCQIKRDINRRRAMRTF

SEQ ID NO: 1559 - protein, 126 aa, Homo sapiens
  SIGNAL -24..-1
MDKSLLLELPILLCCFRALSGSLSMRNDAVNEIVAVKNNFPVIEIVRCRMCHLQFPGEKCSRGRGICTATTEEACMVGRMFKRDGNPWLTFMGCLKNCADVKGIRWSVYLVNFRCXRSHDLCNEDL

SEQ ID NO: 1560 - protein, 102 aa, Homo sapiens
  SIGNAL -16..-1
MDLLWILPSLWLLLLGGPACLKTQEHPSCPGPRELEASKVVLLPSCPGAPGSPGEKGAPGPQGPPGPPGKMGPKGEPGDPVNLLRCQEGPRNCRELLSRAPP

SEQ ID NO: 1561 - protein, 60 aa, Homo sapiens
  SIGNAL -19..-1
MESPSXSAVVLPSTPQASANPSSPYTNSSRKQPMSATLRERLRKTRFSFNSSXNVVNVLK

SEQ ID NO: 1562 - protein, 97 aa, Homo sapiens
  SIGNAL -16..-1
MDFWLWPLYFLPVSGALRILPEVKVEGELGGSVTIKCPLPEMHVRIYLCREMAGSGTCGTVVSTTNFIXAEYKGRVTLRAIPTQESVPSGGNTADRK

SEQ ID NO: 1563 - protein, 82 aa, Homo sapiens
  SIGNAL -34..-1
MVGEAGRDLRRRRAVAVTAEKMAVLAPLIALVYSXPRLSRWLAQPYYLLSXLLSXAFLLVRXLPPLCHGLPTQREXGNPSXX

SEQ ID NO: 1564 - protein, 48 aa, Homo sapiens
  SIGNAL -17..-1
MAQLWLSCFLLPALVVSVAANVAPXFLANMTSVILPEDCLWVPRPSGW

SEQ ID NO: 1565 - protein, 105 aa, Homo sapiens
  SIGNAL -34..-1
MVGEAGRDLRRRRAVAVTAEKMAVLAPLIALVYSVPRLSRWLAQPYYLLSALLSAAFLLVRKLPPLCHGLPTQREXGNPCDFDWREVEILMFLSAIVMMKNRRSS

SEQ ID NO: 1566 - protein, 88 aa, Homo sapiens
  SIGNAL -19..-1
MVAWRSAFLVCLAFSLATLVQRGSGDFDDFNLEDAVKETSSVKQPWDHTTTTTTNRPGTTRAPAKPPGSGLDLADALDDQDDGRRNRV

SEQ ID NO: 1567 - protein, 119 aa, Homo sapiens
  SIGNAL -53..-1
MADPDPRYPRSSIEDDFNYGSSVASATVHIRMAFLRKVYSILSLQVLLTTVTSTVFLYFESVRTFVHESPALILLFALGSLGLIFALXLNRHKYPLNLYLLFGFTLLEALTVAVVVTVL

SEQ ID NO: 1568 - protein, 104 aa, Homo sapiens
  SIGNAL -55..-1
MSSQKGNVARSRPQKHQNTFSFKNDKFDKSVQTKSMNNLSFSELCCLFCCPPCPGKIASKLAFLPPDPTYTLMCDESGSVGLYICLNEQTGSILLEKKMLLSVS

SEQ ID NO: 1569 - protein, 126 aa, Homo sapiens
  SIGNAL -62..-1
MRNKKILKEDELLSETQQAAFHQIAMEPFEINVPKPKRRNGVNFSLAVVVIYLILLTAGAGLLVVQVLNLQARLRVLEMYFLNDTLAAEDSPSFSLLQSAHPGEHLAQGASRLQSCRPNSPGSASX

SEQ ID NO: 1570 - protein, 134 aa, Homo sapiens
  SIGNAL -56..-1
MAPTKPSFQQDPSRRERLQALRKEKSRDAARSRRGKENFEFYELAKLLPLPAAITSQLDKASIIRLTISYLKMRDFANQGDPPWNLRMEGPPPNTSVKVIGAQRRRSPSALAIEVFEAHLGSHILQSWMALYLH

SEQ ID NO: 1571 - protein, 28 aa, Homo sapiens
  SIGNAL -20..-1
MEELQDQALLSVCSTDVTTAHAWLTVLV

SEQ ID NO: 1572 - protein, 28 aa, Homo sapiens
  SIGNAL -20..-1
MEELQDQALLSVCSTDVTTAHAWLTVLV

SEQ ID NO: 1573 - protein, 47 aa, Homo sapiens
  SIGNAL -45..-1
MVGRVRVCRKYPPTTLWEGARGHRQISVSPWNICCAAAAAAAAGSRI

SEQ ID NO: 1574 - protein, 137 aa, Homo sapiens
  SIGNAL -52..-1
MKRLEAKYAPLHLVPLIERLGTPQQIAIAREGDLLTKERLCCGLSMFEVILTRIRSYLQDPIWRGPPPTNGVMHVDECVEFHRLWSAMQFVYCIPVGTNEFTAEQCFGDGLNWAGSPXLSCXASSVALTCSTSVTTC

SEQ ID NO: 1575 - protein, 101 aa, Homo sapiens
  SIGNAL -71..-1
MALVPCQVLRMAILLSYCSILCNYKAIEMPSHQTYGGSWKFLTFIDLVIQAVFFGICVLXDLSSLLTRGSGNQEQERQLKKLISLRDWMLAVLAFLLGFLL

SEQ ID NO: 1576 - protein, 79 aa, Homo sapiens
  SIGNAL -69..-1
MATHHLGLPASQPLPGILSRAPSLPPRSPATRSRVSSPWGESSSSLLFPDCHISFPALTGSQLLGDTIPRPHLPPTAAC

SEQ ID NO: 1577 - protein, 108 aa, Homo sapiens
  SIGNAL -35..-1
MTPSRLPWLLSWVSATAWRAARSPLLCHSLRKTSSSQGGKSELVKQSLKKPKLPEGRFDAPEDSHLEKEPLEKFPDDVXPVTKEKGGPRGPEPTRYGDWERKGRCIDF

SEQ ID NO: 1578 - protein, 81 aa, Homo sapiens
  SIGNAL -51..-1
MEKLRRVLSGQDDEEQGLTAQVLDASSLSFNTRLKWFAICFVCGVFFSILGTGLLWLPGGIKLFAVFYTLGNLAALXVHAX

SEQ ID NO: 1579 - protein, 108 aa, Homo sapiens
  SIGNAL -93..-1
MCENQEEPAGSVCCHRVSACRGGTPGGGRGQSHCRGPDWENNDMAGASLGARFYRQIKRHPGIIPMIGLICLGMGSAALYLLRLALRSPDVWLGQKEQPGALEPPEPQ

SEQ ID NO: 1580 - protein, 134 aa, Homo sapiens
  SIGNAL -16..-1
MAAAGLALLXRRVSSALKSSRSLITPQVPACTGFFLSLLPKSTPNVTSFHQYRLLHTTLSRKGLEEFFDDPKNWGQEKVKSGAAWTCQQLRNKSNEDLHKLWYVLLKERNMLLTLEQEAKRQRLPMPSPERLDR

SEQ ID NO: 1581 - protein, 64 aa, Homo sapiens
MNESKPGDSQNLACVFCRKHDDCPNKYGEKKTKEKWNLTVHYYCLLMSSGIWQRGKEEEGVMVF

SEQ ID NO: 1582 - protein, 79 aa, Homo sapiens
MAVARAGVLGVQWLQRASRNVMPLGARTASHMTKDMFPGPYPRTPEERAAAAKKYNMRVEDYEPYPDDGMGYGDLFLXV

SEQ ID NO: 1583 - protein, 66 aa, Homo sapiens
MEVDAPGVDGRDGLRERRGFSEGGRQNFDVRPQSGANGLPKHSYWLDLWLFILFDVVVFLFVYFLP

SEQ ID NO: 1584 - protein, 45 aa, Homo sapiens
MYVYVCVWVCVYTVESKLENSSIYPPPSPVEXKKIFTFVTFLFPP

SEQ ID NO: 1585 - protein, 25 aa, Homo sapiens
MGPGGALHGGMKTLLPWTARASRSP

SEQ ID NO: 1586 - protein, 98 aa, Homo sapiens
MYGKGKSNSSAVPSDSQAREKLALYVYEYLLHVGAQKSAQTFLSEIRWEKNITLGEPPGFLHSWWCVFWDLYCAAPERRETCEHSSEAKAFHDYVXNI

SEQ ID NO: 1587 - protein, 50 aa, Homo sapiens
MCLLEVPGATKLLAARRTLKRNGISPPNQEGLALLLGELTTHKQMRTKTE

SEQ ID NO: 1588 - protein, 32 aa, Homo sapiens
MNRTAMRASQKDFENSXNQVKLLKKDPGNEXS

SEQ ID NO: 1589 - protein, 58 aa, Homo sapiens
MASSGAGDPLDSKRGEAPFAQRIDPTREKLTPEQLHSMRQAELPSGRRSYHGGEPGTS

SEQ ID NO: 1590 - protein, 98 aa, Homo sapiens
MSSDDKSKSNDPKTEPKNCDPKCEQKCESKCQPSCLKKLLQRCFEKCPWEKCPAPPKCLPCPSQSPSSCPPQPCTKPCPPKCPSSCPHACPXPCPPPE

SEQ ID NO: 1591 - protein, 43 aa, Homo sapiens
MCGGWDPVAHPCRSCPSHARRRVFVVTPCCHLFSSLCEDLDWQ

SEQ ID NO: 1592 - protein, 157 aa, Homo sapiens
MATPPKRRAVEATGEKVLRYETFISDVLQRDLRKVLDHRDKVYEQLAKYLQLRNVIERLQEAKHSELYMQVDLGCNFFVDTVVPDTSRIYVALGYGFFLELTLAEALKFIDRKSSLLTELSNSLTKDSMNIKAHIHMLLEGLRELQGLQNFPEKPHH

SEQ ID NO: 1593 - protein, 119 aa, Homo sapiens
MEASALTSSAVTSVAKVVRVASGSAVVLPLARIATVVIGGVVAVPMVLSAMGFTAAGIASSSIAAKMMSAAAIANGGGVASGSLVATLQSLGATGLSGLTKXILGSIGSAIAAVIARFY

SEQ ID NO: 1594 - protein, 81 aa, Homo sapiens
MYIQCCEWLQSWRSKDEFCLEESGKASWRREQWHGPXXVRSFQFIPFKHCSHVAFKHSIVLAVTQAHSAKGSTSFSAMRTY

SEQ ID NO: 1595 - protein, 65 aa, Homo sapiens
MVGVSVCHHIRVGIKRRKAALLELCGLLQVRVAGNRTTLLLEEKRNSFSAXTRKAVFFSGDLHFS

SEQ ID NO: 1596 - protein, 111 aa, Homo sapiens
MPSRTARYARYSPRQRRRRMLADRSVRFPNDVLFLDHIRQGDLEQVGRFIRTRKVSLATIHPSGLAALHEAVLSGNLECVKLLVKYGADIHQRDEAGWTPLHIACSDGYLT

SEQ ID NO: 1597 - protein, 33 aa, Homo sapiens [sequence omitted]

SEQ ID NO: 1598 - protein, 113 aa, Homo sapiens
MDPNPRAALERQQLRLRERQKFFEDILQPETEFVFPLSHLHLESQRPPIGSISSMEVNVDTLEQVELIDLGDPDAADVFLPCEDPPPTPQSSGVDNHLEELSLPXAYIRQDHI

SEQ ID NO: 1599 - protein, 58 aa, Homo sapiens
MVVFGYEAGTKPRDSGVVPVGTEEAPKDTKYISNGDIWNNSWFLWNILKLPVQTLLQG

SEQ ID NO: 1600 - DNA, 247 bp, Homo sapiens
gaaaattactttgaccttttgttagtgatcccattcagctagtaccaagctgaagattgatattcgttaatggttaatataaatttactgctctaggttaagcctaacatatgtaattgctactagcctattactttttagtccattgggaatcactaaaaaaagtagaggctttagcttcattcctcggctgcttaaatcatattgtaatgttttaaattgttatgtcgtcctgtataaccttagg

SEQ ID NO: 1601 - DNA, 225 bp, Homo sapiens
aaaattattttgagacaaaacatgggaaaggagggagttggccaggagtttatcatgaagcatatacaggagtcatcccctacgttgacactggtaagttgacttcagtcacatgaaacatgtcacctttccataaatactccattcccttttgtgattttgttctttgcacatgttgttctatctctgcctggaatgtgttctccaccttttgattgtctgcca

SEQ ID NO: 1602 - DNA, 258 bp, Homo sapiens
gtgaccacagtctgcagaggccagagagagcaggaaaggaaatggaaaggaacctcaccttcatgcttggggaaaaggagaaacctgtgttaatgtgtcttcccaacatcccactctcttcagcaatcgctggaacagccatgggccatccctgctgagtcaggaaagaagctgagggaagagtcgggattgaaaagcagcagacaagggaaatgtggacacaagcacatgaagagaacaccatgtgaacataaagat

SEQ ID NO: 1603 - DNA, 341 bp, Homo sapiens
aaggttacttgactgggagttctcagacctccagtttcagccctgccctcagcctccaatccgtaagagayacccagccccagcaattggattgggcagcccgtcttgacacaccactgtgctgagtgcttgaggacgtgtttcaacagatggttggggttagtgtgtgtcatcacattcgagtggggattaagagaaggaaggctgccttgctggagctgtgtggtcttctccaagtgagagtcgcaggcaatagaactactttgcttttggaggaaaaggaggaattcattttcagcagacacaagaaaagcagtttttttttcaggtgctgacggcca

SEQ ID NO: 1604 - DNA, 292 bp, Homo sapiens
cactggcgcgggttgagttccctgttgcccttggtctcggggtcgctgtmggcgctgaggctgcagctatcatggtgaacttacttcagattgtgcgggaccactgggttcatgttcttgtccctatgggatttgtcattggatgttatttagacagaaagagtgatgaacggctaactgccttccggaacaagagtatgttatttaaaagggaattgcaacccagtgaagaagttacctggaagtaaagactggctagattatcgaatgttcacattttaaagttctgaga

SEQ ID NO: 1605 - DNA, 357 bp, Homo sapiens
ctgctctaagctgcagcaagagaaactgtgtgtgaggggaagaggcctgtttcgctgtcgggtctctagttcttgcacgctctttaagagtctgcactggaggaactcctgccattaccagctcccttcttgcagaagggagggggaaacatacatttattcatgccagtctgttgcatgcaggctttttggcttcctaccttgcaacaaaataattgcaccaactccttagtgccgattccgcccacagagagtcctggarccacagtcttttttgctttgcattgtaggagagggactaagtgctagagactatgtcgctttcctgagctaccgagagcgctcgtgaactggaat

SEQ ID NO: 1606 - DNA, 293 bp, Homo sapiens
  misc_feature 13: n=a, g, c or t Oligonucleotide
attccctacccancagccctcgcgcggtccggcacagcggacaccaggactccaaaatggcgtcagttggtgagtgtccggccccagtaccagtgaaggacaagaaacttctggaggtcaaactgggggagctgccaagctggatcttgatgcggracttcagtcctagtggcattttcggagcgtttcaaaraggttacaccggtactacaacaagtacatcaatgtgaagaaggggagcatctcggggattaccatggtgctaccctaccacacattcgaagaacccgtat

SEQ ID NO: 1607 - DNA, 361 bp, Homo sapiens
  misc_feature 323: n=a, g, c or t Oligonucleotide
tgttgtctttatcagacttacattgcctctgtgaatatcagccttggtctactccaagtgcaggacaaacacaaagaactctctgcacagttcattactccattaggtggttcagatgcaattccagcccttagtcaggttctttccagtgtcctcaaacacagtaaggagagtgctctaagtgactctttgtgtctcacacaatctcttgggttcccaggtcactggtgtagtagccagctgcatccaagaagccaggtgagcctgtgccaccaatcacagatactccttaccaaccatctgccaacccatgccagccctgntgcccatggatgtgcggctgtccatgtgccacgcccac

SEQ ID NO: 1608 - DNA, 305 bp, Homo sapiens
aagacggaagctcggttgatgtttctgcagaagttttcccccttggtcggtggcggastgctgagcgcgatagtagcagctccggcggcagcaacattgactacgaggaatggcggcggctgccgcaggacctgcagcatcccagaggtgcagattttaatttcagtgactgaattaaaaggtgtcaagaagctcgaatggtatgtaggtctcccatggtatttcaatttaaaaagaagtaagcacttgaaattttttggtttaagcaaatttgtttttacctttataatttattttaaataata

SEQ ID NO: 1609 - DNA, 242 bp, Homo sapiens
  misc_feature 152: n=a, g, c or t Oligonucleotide
aatctggtctttctgtagacccaagtcagaaggaaccatttgtggagttaaatagaatattagaggcattaaaggtcagagttctgagacctgctctggagtgggcagtgtcaaaccgggaaatgcttatagctcaaacagctccttggaanttaagctacacagactgtattttattagcttgttaatgggtggaaccacaaatcagcgagaggcattacaatatgctaaaaattttcagc

SEQ ID NO: 1610 - DNA, 196 bp, Homo sapiens
ggaagcgatttcatagccacggtttttggctttcatcgctttttctacatgtttttagcctcaccagaagtctttcatctcggtggtccaactcaggatctcagcctcattattttcttacccttctggagtgcatatgtgcctttacagttctgtttgcaaacgctgtctagcatactaagaggatgttagcaaa

SEQ ID NO: 1611 - DNA, 228 bp, Homo sapiens
atattgaataagcgacccggcctcctagggggtcgtcgtggtgcagacagtttagcagaacagcctccgcggctccggggagaaggtgaggtcttgtatggatgggaagggtgaggtgcgtcggccagaggcttatttattgacgggactgtttcctttggcccacgcgacgtagcttctgttgtccttgactgggcgccgcctcccgccccgccgcctcggaagccc

SEQ ID NO: 1612 - DNA, 221 bp, Homo sapiens
  misc_feature 108: n=a, g, c or t Oligonucleotide
tattttagagatggaacaaagagaacacatagatattcaataatttactcaaaagtctgtgaggagccctagaaagaaattcaggtctcctatgtactgatcacagcncagaaccccaggaagccagaggtgttccaccccaatccttcaccctcaccccacatcatggtggcccctgggacctggatggaaaacctctggcwtcctggggttctgggctg

SEQ ID NO: 1613 - DNA, 360 bp, Homo sapiens
agttgcctgcagagcctgaggtcagggaaggtctcagatggttcataccttggtgtatacatgagttcataggcctgggattaaggattatccctgcaatcttgcctgccttgcagataagctactttctgaatcctaaagcgctcttccagctttcacatttgattccgtggcagaaggctcacagcctcacaaagtggagacaggcagacagtcccacctcatttcaactccagagttggggaacgtgctgggggtgctcagccagagcctctcagccaggccttgtgaggcagagggatccttaccaggcagatggtctggaggagaggcagaccgggagaaagcatagtgtgccag

SEQ ID NO: 1614 - DNA, 171 bp, Homo sapiens
cagtaaggtagcaggattcaaattattttttccagtattgacatttagaatgtcatgttggacatttaaaatttttctggttgtagcctcattactgtatagaaatcaactaccagatgagtagttgacagacacagctagcttggttgcttgcttgctgttcttgccgcc

SEQ ID NO: 1615 - DNA, 193 bp, Homo sapiens
acatctttagtagagacgggcaatccacccgcctcggctcccagagtactgggatgacaggcgtgagcaccacgtccggccacaaaagagctttgatgcacacggtgacagccacatggtgcacccggaagaacaaggggcctgaagttagttagaccctccttgctggttctaccacagtcgcacgccccac

SEQ ID NO: 1616 - DNA, 349 bp, Homo sapiens
  misc_feature 99: n=a, g, c or t Oligonucleotide
atggttggaatcatattcagcaggagtaagctgactaacttacaaaaacaggtgtgtgctcatattgtccaagctattcgcatggaagctaccagagtncgtgaagaatgggaacatgctatatcaagcaaagaaaatgccaattctcagccaaatgatgaagatgcctcctctgatgcctactgctttgagctgctctctatggttttagcactgagtggctctaacgttggccggcaatatctggctcaacagctaaccctgcttcaggatctcttccgctgcttcacacagcctctcctagagtccagagacaggtacctctttactagaagagtttgctgaagta

SEQ ID NO: 1617 - DNA, 155 bp, Homo sapiens
atacacatatccatggtttgtgagaggctcctcactacccgtcctgtctcagaatgtcagaatgccctgtttccttcccttttgtggacaagtcaactctatacaatatttgaagggattattctgaacccatctgaatgaccaaggcctgaggc

SEQ ID NO: 1618 - DNA, 185 bp, Homo sapiens
cttgaaatgggctgagtccctcttgctcacccttgacttggaaaaaccagtttctcttttattgtctgttactaatctctattctaaaaattcagctcaattctcaaccatactccaaactctctcttttccagctacctttactccctctccttcaattccactttcctctgcttacttttttt

SEQ ID NO: 1619 - DNA, 169 bp, Homo sapiens
gggcgcaatggcggatacgctggagtcctcgctggaggacccactgcggagtttgtgcgagttttggagaagcgggatggtacagtgctacgactacagcagtatagctccggtggcgtgggtgcgttgtgtgggacgctgccattgtcctttctaaatacctggaaac

SEQ ID NO: 1620 - DNA, 246 bp, Homo sapiens
  misc_feature 122: n=a, g, c or t Oligonucleotide
cagaggttttgttttcttcataatttttatcactatctgaattattttgattctttgtttatttgtgcatttcacgttgtttcctatattccgttcaatgtaagctctatgagaccaagaanstgggcagttttattcaccataagtattccaagccctagtggttcctggcacattttgtattcacaataaatatttgttaagtcaatgaccagatgaatggcttttaaactcaagatagttttt

SEQ ID NO: 1621 - DNA, 280 bp, Homo sapiens
agtctagggaaagtcattcagtggatgtgatcttggctcacaggggacgatgtcaagctcttcctggctccttctcagccttgttgctgtaactgctgctcagtccaccattgaggaacaggccaaagacatttttggacaagtttaaccacgaagccgaagacctgttctatcaaagttcacttgcttcttggaattataacaccaatattactgaagagaatgtccaaaacatgaataatgctggggacaaatggtctgcctttttaaaggaacagtc

SEQ ID NO: 1622 - DNA, 400 bp, Homo sapiens
  misc_feature 43: n=a, g, c or t Oligonucleotide
agggagggacagagagcgaactgtcagatcggagcgagagcgngcgcccgagagagggagagagagagagggagggagaggaaaagtgagagagggaaagagagcgcgaacgagggcgcagagcgagctcctgctgcaactctgctccagcacggccagcgccagcgcccgccgtcggtgcactctacgagccgtgcagcgtgcccactggagttgttgtgtatcaaggatcgatcccctatatgcacacacacacctccacctccaccaatgcactcttcttcctcctccttctccagacaactgctgggaaaaaaataaaacaccaaccccaaccgtcagcaacaaggtaasmgagcgattcgacatcattttttttcctgttcaattttttccttgt

What is claimed is:

1. An isolated or purified signal peptide:
   a) consisting of residues −16 to −1, inclusive, of SEQ ID NO: 831, or a fragment thereof; and
   b) directing the extracellular secretion of a polypeptide if said signal peptide is operably linked thereto.

2. A method of producing the polypeptide of claim 1, comprising the steps of:
   a) culturing a host cell capable of expressing said polypeptide under conditions suitable for producing said polypeptide; and
   b) isolating and purifying said polypeptide produced by said host cell.

3. An isolated, purified, or recombinant signal peptide consisting of an amino acid sequence that has at least 95% identity to the signal peptide of claim 1 and directs the extracellular secretion of a polypeptide if said signal peptide is operably linked thereto.

4. A purified polypeptide comprising the signal peptide of claim 1 fused in frame to a heterologous polypeptide.

5. A method of producing the polypeptide of claim 3, comprising the steps of:
   a) culturing a host cell capable of expressing said polypeptide under conditions suitable for producing said polypeptide; and
   b) isolating and purifying said polypeptide produced by said host cell.

6. The signal peptide of claim 3, wherein said signal peptide consists of residues −16 to −1, inclusive, of SEQ ID NO: 831.

7. A purified polypeptide comprising the signal peptide of claim 3 fused in frame to a heterologous polypeptide.

8. A method of producing the polypeptide of claim 4, comprising the steps of:
   a) culturing a host cell capable of expressing said polypeptide under conditions suitable for producing said polypeptide; and
   b) isolating and purifying said polypeptide produced by said host cell.

9. The polypeptide of claim 4, wherein said signal peptide consists of amino acids −16 to −1, inclusive, of SEQ ID NO: 831.

10. A method of producing the polypeptide of claim 7, comprising the steps of:
    a) culturing a host cell capable of expressing said polypeptide under conditions suitable for producing said polypeptide; and
    b) isolating and purifying said polypeptide produced by said host cell.

* * * * *

UNITED STATES PATENT AND TRADEMARK OFFICE
CERTIFICATE OF CORRECTION

PATENT NO.    : 6,822,072 B1
DATED         : November 23, 2004
INVENTOR(S)   : Jean-Baptiste Dumas Milne Edwards, Aymeric Duclert and Jean-Yves Giordano It is certified that error appears in the above-identified patent and that said Letters Patent is hereby corrected as shown below:

Column 2,
Line 28, "268:7314," should read -- 268:731-4, --.

Column 4,
Line 1, "6:236244," should read -- 6:236-244, --.
Lines 3 and 4, "Spel" should read -- SpeI --.

Column 5,
Line 19, "tenn" should read -- term --.

Column 7,
Line 61, "extended,cDNAs" should read -- extended cDNAs --.

Column 8,
Line 63, "SEQ D Nos." should read -- SEQ ID NOs. --.

Column 12,
Line 35, "15541580" should read -- 1554-1580 --.

Column 20,
Line 5, "gene D" should read -- gene II --.
Line 21, "polyerase" should read -- polymerase --.

Column 21,
Line 38, "fill-length" should read -- full-length --.

Column 25,
Line 8, "Ednian" should read -- Edman --.
Line 9, "N-terrinal" should read -- N-terminal --.

Column 27,
Line 41, "24728" should read -- 24-728 --.

Column 30,
Line 11, "nucleobde(s)" should read -- nucleotide(s) --.

Column 31,
SEQ ID NO: 415, "53" should read -- S3 --.

UNITED STATES PATENT AND TRADEMARK OFFICE
CERTIFICATE OF CORRECTION

PATENT NO. : 6,822,072 B1
DATED : November 23, 2004
INVENTOR(S) : Jean-Baptiste Dumas Milne Edwards, Aymeric Duclert and Jean-Yves Giordano It is certified that error appears in the above-identified patent and that said Letters Patent is hereby corrected as shown below:

Column 33,
SEQ ID NO: 800, "km" should read -- krn --.

Column 34,
Line 50, "polynucleolide" should read -- polynucleotide --.

Column 45,
Line 34, "5'ESTs Consensus" should read -- 5'ESTs, Consensus --.
Line 53, "the type" should read -- the tissue type --.

Column 54,
Lines 12-14, "647  F:1   should read -- 647   F:1
            643  F:1                648   F:1
            649  F:1"                649   F:1 --.

Column 59,
Line 38, "by.,a" should read -- by a --.

Column 60,
Line 41, "it'may" should read -- it may --.

Column 61,
Line 53, "bioinfomnatics" should read -- bioinformatics --.

Column 67,
Line 31, "403410" should read -- 403-410 --.

Column 68,
Line 1, "17:4941" should read -- 17:49-61 --.

Column 69,
Line 61, "10%-20%=80%" should read -- 100%-20%=80% --.

Column 70,
Line 63, "Gene H" should read -- Gene II --.

Column 72,
Line 29, "10:685686" should read -- 10:685-686 --.

UNITED STATES PATENT AND TRADEMARK OFFICE
CERTIFICATE OF CORRECTION

PATENT NO. : 6,822,072 B1
DATED : November 23, 2004
INVENTOR(S) : Jean-Baptiste Dumas Milne Edwards, Aymeric Duclert and Jean-Yves Giordano It is certified that error appears in the above-identified patent and that said Letters Patent is hereby corrected as shown below:

Column 75,
Line 6, "pX1 contains" should read -- pXT1 contains --.
Line 16, "BgIII" should read -- BG1II --.

Column 77,
Line 59, "Cytokine Cell" should read -- Cytokine, Cell --.

Column 78,
Line 12, "145:17061712" should read -- 145:1706-1712 --.

Column 79,
Line 36, "Takcai" should read -- Takai --.
Line 44, "134:536544" should read -- 134:536-544 --.
Line 47, "67:40624069" should read -- 67:4062-4069 --.
Line 57, "Darzynliewicz" should read -- Darzynkiewicz --.
Line 59, "7:659670" should read -- 7:659-670 --.

Column 81,
Line 2, "tsplants" should read -- transplants --.

Column 85,
Line 11, "tendonaigament-like" should read -- tendon/ligament-like --.
Line 20, "in viva" should read -- in vivo --.

Column 87,
Line 55, "45:413419" should read -- 45:413-419 --.
Line 57, "35:467474" should read -- 35:467-474 --.

Column 89,
Line 50, "Inclining" should read -- killing --.
Line 63, "behaviora" should read -- behavioral --.

Column 91,
Line 48, "*Chromalographia*" should read -- *Chromatographia* --.

Column 95,
Line 40, "GIC" should read -- G/C --.
Line 62, "Acids Positional" should read -- Acids, Positional --.

UNITED STATES PATENT AND TRADEMARK OFFICE
CERTIFICATE OF CORRECTION

PATENT NO.    : 6,822,072 B1
DATED         : November 23, 2004
INVENTOR(S)   : Jean-Baptiste Dumas Milne Edwards, Aymeric Duclert and Jean-Yves Giordano It is certified that error appears in the above-identified patent and that said Letters Patent is hereby corrected as shown below:

Column 97,
Line 49, "probes arc" should read -- probes are --.

Column 98,
Line 11, "P2" should read -- $P^{32}$ --.
Line 18, "$^{32}$p" should read -- $^{32}P$ --.
Line 67, "p$^{32}$" should read -- $P^{32}$ --.

Column 99,
Line 64, "(FK)" should read -- (TK) --.

Column 100,
Line 9, "Acids Positional" should read -- Acids, Positional --.

Column 101,
Line 40, "Collected" should read -- Colcemid --.

Column 112,
Line 23, "in, both" should read -- in both --.

Column 113,
Line 11, "CIA" should read -- CTA --.
Line 19, "release 20" should read -- release 2.0 --.

Column 115,
Line 66, "antiseese" should read -- antisense --.

Column 119,
Line 30, "region (b)" should read -- region (h) --.
Line 61, "271:2745627461" should read -- 271:27456-27461 --.
Line 63, "234:675680" should read -- 234:675-680 --.

Column 120,
Line 56, "$3^4$ edition" should read -- $3^{rd}$ edition --.
Lines 66-67, "990%, 98%, 97%, 96%, 95%, 900%, 85%" should read
-- 99%, 98%, 97%, 96%, 95%, 90%, 85% --.

UNITED STATES PATENT AND TRADEMARK OFFICE
CERTIFICATE OF CORRECTION

PATENT NO. : 6,822,072 B1
DATED : November 23, 2004
INVENTOR(S) : Jean-Baptiste Dumas Milne Edwards, Aymeric Duclert and Jean-Yves Giordano It is certified that error appears in the above-identified patent and that said Letters Patent is hereby corrected as shown below:

Column 122,
Line 18, "Continuing" should read -- containing --.

Column 124,
Lines 60-61, "polynucleotides" should read -- polynucleotide --.

Column 127,
Lines 39-40, "MicrosofR WORD" should read -- MicrosoftWORD --.

Column 128,
Line 49, "desired polynucleotides." should read -- desired polynucleotide. --.

Signed and Sealed this

Twenty-fourth Day of May, 2005

JON W. DUDAS
*Director of the United States Patent and Trademark Office*